US012618065B2

(12) United States Patent
Harper

(10) Patent No.: US 12,618,065 B2
(45) Date of Patent: *May 5, 2026

(54) MiRNA DETARGETING SYSTEM FOR TISSUE SPECIFIC INTERFERENCE

(71) Applicant: RESEARCH INSTITUTE AT NATIONWIDE CHILDREN'S HOSPITAL, Columbus, OH (US)

(72) Inventor: Scott Quenton Harper, Powell, OH (US)

(73) Assignee: RESEARCH INSTITUTE AT NATIONWIDE CHILDREN'S HOSPITAL, Columbus, OH (US)

( * ) Notice: Subject to any disclaimer, the term of this patent is extended or adjusted under 35 U.S.C. 154(b) by 1033 days.

This patent is subject to a terminal disclaimer.

(21) Appl. No.: 16/651,814

(22) PCT Filed: Oct. 2, 2018

(86) PCT No.: PCT/US2018/054005
§ 371 (c)(1),
(2) Date: Mar. 27, 2020

(87) PCT Pub. No.: WO2019/070741
PCT Pub. Date: Apr. 11, 2019

(65) Prior Publication Data
US 2020/0248179 A1 Aug. 6, 2020

Related U.S. Application Data

(60) Provisional application No. 62/566,966, filed on Oct. 2, 2017.

(51) Int. Cl.
| | |
|---|---|
| *C12N 15/113* | (2010.01) |
| *A61K 35/76* | (2015.01) |
| *C12N 7/00* | (2006.01) |
| *C12N 15/86* | (2006.01) |
| *A61K 48/00* | (2006.01) |

(52) U.S. Cl.
CPC ............ *C12N 15/113* (2013.01); *A61K 35/76* (2013.01); *C12N 7/00* (2013.01); *C12N 15/86* (2013.01); *A61K 48/00* (2013.01); *C12N 2750/14143* (2013.01)

(58) Field of Classification Search
CPC ................. C12N 15/113; C12N 15/86; C12N 2750/14143; C12N 2310/141; C12N 15/111; C12N 15/63; C12N 7/00; C12N 2330/51; A61K 48/00; A61K 35/76; Y02A 50/30
See application file for complete search history.

(56) References Cited

U.S. PATENT DOCUMENTS

| | | | |
|---|---|---|---|
| 5,173,414 A | 12/1992 | Lebkowski et al. | |
| 5,658,776 A | 8/1997 | Flotte et al. | |
| 5,786,211 A | 7/1998 | Johnson | |
| 5,871,982 A | 2/1999 | Wilson et al. | |
| 6,258,595 B1 | 7/2001 | Gao et al. | |
| 6,566,118 B1 | 5/2003 | Atkinson et al. | |
| 7,250,289 B2 * | 7/2007 | Zhou ..................... | C12Q 1/6837 536/23.1 |
| 7,683,036 B2 * | 3/2010 | Esau ....................... | A61P 37/00 536/23.1 |
| 9,181,544 B2 * | 11/2015 | Davidson ................ | A61P 25/14 |
| 9,597,380 B2 * | 3/2017 | Chakraborty .......... | A61K 39/00 |
| 10,189,888 B2 * | 1/2019 | Falkner .................. | C12N 15/86 |
| 11,162,102 B2 * | 11/2021 | Minshull .............. | C12N 9/1241 |
| 2010/0186103 A1 * | 7/2010 | Gao .................... | A01K 67/0275 800/13 |
| 2012/0225034 A1 | 9/2012 | Belayew et al. | |
| 2013/0195801 A1 | 8/2013 | Gao et al. | |
| 2017/0166925 A1 | 6/2017 | Gao et al. | |
| 2019/0328791 A1 * | 10/2019 | McKinney-Freeman ..................... | C12N 5/0605 |

FOREIGN PATENT DOCUMENTS

| | | | |
|---|---|---|---|
| WO | 1995/13365 A1 | 5/1995 | |
| WO | 1995/13392 A1 | 5/1995 | |
| WO | 1996/17947 A1 | 6/1996 | |
| WO | 1997/06243 A1 | 2/1997 | |
| WO | 1997/08298 A1 | 3/1997 | |
| WO | 1997/09441 A2 | 3/1997 | |
| WO | 1997/21825 A1 | 6/1997 | |
| WO | 1998/09657 A2 | 3/1998 | |
| WO | 1999/11764 A2 | 3/1999 | |
| WO | 2001/83692 A2 | 11/2001 | |
| WO | 2002/53703 A2 | 7/2002 | |
| WO | 2010/138263 A2 | 12/2010 | |
| WO | 2011/133890 A1 | 10/2011 | |
| WO | WO 2013016352 | * | 7/2012 |

(Continued)

OTHER PUBLICATIONS

Suhy et al (Mol Ther Sep. 4, 2012, vol. 20, No. 9, pp. 1737-1749, published online Jun. 26, 2012).*

Ansseau, Eugénie, et al. "Antisense oligonucleotides used to target the DUX4 mRNA as therapeutic approaches in faciosscapulohumeral muscular dystrophy (FSHD)." Genes 8.3 (2017): 93.*

Carter, Adeno-associated virus vectors, Curr. Opin. Biotechnol., 3(5):533-539 (1992).

Choudhury et al., In vivo selection yields AAV-B1 capsid for central nervous system and muscle gene therapy, Mol. Ther., 24(7):1247-1257 (2016).

Clark et al., A stable cell line carrying adenovirus-inducible rep and cap genes allows for infectivity titration of adeno-associated virus vectors, Gene. Ther., 3:1124-1132 (1996).

(Continued)

*Primary Examiner* — Kimberly Chong
(74) *Attorney, Agent, or Firm* — MARSHALL, GERSTEIN & BORUN LLP

(57) ABSTRACT

The present disclosure relates to a tissue-specific promoter system for expressing microRNA (miRNA) for RNA interference-based methods of gene therapy. In these systems, the miRNA will inhibit gene expression or replace natural miRNA expression using microRNA.

20 Claims, 4 Drawing Sheets

Specification includes a Sequence Listing.

(56) References Cited

FOREIGN PATENT DOCUMENTS

WO      2013/016352 A1     1/2013
WO      2017/173411 A1     10/2017

OTHER PUBLICATIONS

Clark et al., Highly purified recombinant adeno-associated virus vectors are biologically active and free of detectable helper and wild-type viruses, Hum. Gene. Ther., 10(6):1031-1039 (1999).

Cserjesi et al., Myogenin induces the myocyte-specific enhancer binding factor MEF-2 independently of other muscle-specific gene products, Mol. Cell. Biol., 11:4854-4862 (1991).

De et al., High levels of persistent expression of alpha1-antitrypsin mediated by the nonhuman primate serotype rh.10 adeno-associated virus despite preexisting immunity to common human adeno-associated viruses, Mol. Ther., 13(1):67-76 (2006).

Fechner et al., Cardiac-targeted RNA interference mediated by an AAV9 vector improves cardiac function in coxsackievirus B3 cardiomyopathy, J. Mol. Med., 86:987-997 (2008).

Flotte et al., Gene expression from adeno-associated vrrus vectors in airway epithelial cells, Am. J. Respir. Cell Mol. Biol., 7:349-356 (1992).

Gao et al., Clades of adeno-associated viruses are widely disseminated in human tissues, J. Virol., 78:6381-6388 (2004).

Hermonat et al., Use of adeno-associated virus as a mammalian DNA cloning vector: transduction of neomycin resistance into mammalian tissue culture cells, Proc. Natl. Acad. Sci. USA, 81:6466-6470 (1984).

International Application No. PCT/US2018/054005, International Preliminary Report on Patentability, mailed Apr. 16, 2020.

International Application No. PCT/US2018/054005, International Search Report and Written Opinion, mailed Dec. 26, 2018.

Johnson et al., Muscle creatine kinase sequence elements regulating skeletal and cardiac muscle expression in transgenic mice, Mol. Cell. Biol., 9:3393-3399 (1989).

Laughlin et al., Cloning of infectious adeno-associated virus genomes in bacterial plasmids, Gene., 23:65-73 (1983).

Lebkowski et al., Adeno-associated virus: a vector system for efficient introduction and integration of DNA into a variety of mammalian cell types, Mol. Cell. Biol., 8:3988-3996 (1988).

Lemmers et al., Supporting Online Material for, A Unifying Genetic Model for Facioscapulohumeral Muscular Dystrophy, Aug. 19, 2010 highlight DUX4.

Mader et al., A steroid-inducible promoter for the controlled overexpression of cloned genes in eukaryotic cells, Proc. Natl. Acad. Sci. USA, 90:5603-5607 (1993).

Marsic et al., Vector design Tour de Force: integrating combinatorial and rational approaches to derive novel adeno-associated virus variants, Mol. Ther., 22(11):1900-1909 (2014).

Mccarty, Self-complementary AAV vectors; advances and applications, Mol. Ther., 16(10):1648-1656 (2008).

Mclaughlin et al., Adeno-associated virus general transduction vectors: analysis of proviral structures, J. Virol., 62:1963-1973 (1988).

Mcmanus et al., Gene silencing using micro-RNA designed hairpins, RNA, 8(6):842-850 (2002).

Mori et al., Two novel adeno-associated viruses from cynomolgus monkey: pseudotyping characterization of capsid protein, Virology, 330(2):375-383 (2004).

Muscat et al., Multiple 5'-flanking regions of the human alpha-skeletal actin gene synergistically modulate muscle-specific expression, Mol. Cell. Biol., 7:4089-4099 (1987).

Muzyczka, Use of adeno-associated virus as a general transduction vector for mammalian cells, Curr. Top. Microbiol. Immunol., 158:97-129 (1992).

Neguembor et al., In junk we trust: repetitive DNA, epigenetics and facioscapulohumeral muscular dystrophy, Epigenomics, 2(2):271-287 (2010).

Paul et al., Increased viral titer through concentration of viral harvests from retroviral packaging lines, Hum. Gene Ther., 4:609-615 (1993).

Perrin et al., An experimental rabies vaccine produced with a new BHK-21 suspension cell culture process: use of serum-free medium and perfusion-reactor system, Vaccine, 13:1244-1250 (1995).

Rodino-Klapac et al., A translational approach for limb vascular delivery of the micro-dystrophin gene without high vol. or high pressure for treatment of Duchenne muscular dystrophy, J. Transl. Med., 5:45 (2007).

Samulski et al., Cloning of adeno-associated virus into pBR322: rescue of intact virus from the recombinant plasmid in human cells, Proc. Natl. Acad. Sci. USA, 79:2077-2081 (1982).

Samulski et al., Helper-free stocks of recombinant adeno-associated viruses: normal integration does not require viral gene expression, J. Virol., 63:3822-3828 (1989).

Schnepp et al., Highly purified recombinant adeno-associated virus vectors. Preparation and quantitation, Methods Mol. Med., 69:427-443 (2002).

Semenza et al., Hypoxia-inducible nuclear factors bind to an enhancer element located 3' to the human erythropoietin gene, Proc. Natl. Acad. Sci. USA, 88:5680-5684 (1991).

Senapathy et al., Molecular cloning of adeno-associated virus variant genomes and generation of infectious virus by recombination in mammalian cells, J. Biol. Chem., 259:4661-4666 (1984).

Srivastava et al., Nucleotide sequence and organization of the adeno-associated virus 2 genome, J. Virol., 45:555-564 (1983).

Tratschin et al., A human parvovirus, adeno-associated virus, as a eucaryotic vector: transient expression and encapsidation of the procaryotic gene for chloramphenicol acetyltransferase, Mol. Cell. Biol., 4:2072-2081 (1984).

Tratschin et al., Adeno-associated virus vector for high-frequency integration, expression, and rescue of genes in mammalian cells, Mol. Cell. Biol., 5:3251-3260 (1985).

Wallace et al., Developing RNAi therapy for FSHD, Mol. Ther., 17(Suppl. 1):S151 (2009).

Wei et al., Therapeutic RNAi for dominant muscle disease, Mol. Ther., 17(Suppl 1):S200 (2009).

Weintraub et al., The myoD gene family: nodal point during specification of the muscle cell lineage, Science, 251:(4995)761-766 (1991).

Wuebbles et al., Testing the effects of FSHD candidate gene expression in vertebrate muscle development, Int. J. Clin. Exp. Pathol., 3(4):386-400 (2010).

Xiao et al., Production of high-titer recombinant adeno-associated virus vectors in the absence of helper adenovirus, J. Virol., 72:2224-2232 (1998).

Danda et al., Targeted Expression of Suicide Gene by Tissue-Specific Promoter and MicroRNA Regulation for Cancer Gene Therapy, Plos One., 8(12):e83398 (2013).

European Application No. 18863924.9, European Search Report and Opinion, mailed Apr. 15, 2021.

Geisler et al., microRNA122-regulated transgene expression increases specificity of cardiac gene transfer upon intravenous delivery of AAV9 vectors, Gen. Ther., 18(2):199-209 (2010).

Wolff et al., Effect of tissue-specific promoters and microRNA recognition elements on stability of transgene expression after hydrodynamic naked plasmid DNA delivery, Hum. Gen. Ther., 20(4):374-388 (2009).

Zhou et al., A tightly regulated Pol Ill promoter for synthesis of miRNA genes in tandem, Bio. et Biop. Acta., 1779(11):773-779 (2008).

* cited by examiner

SEQ ID NO: 3 – Wild type U6-1 Promoter

ACGTGACGGAGCGTGACCGCGCGCCGAGCGCGCGCCAAGGTCGGGCAGGAAGAGG
GCCTATTTCCCATGATTCCTTCATATTTGCATATACGATACAAGGCTGTTAGAGAGAT
AATTAGAATTAATTTGACTGTAAACACAAAGATATTAGTACAAAATACGTGACGTA
GAAAGTAATAATTTCTTGGGTAGTTTGCAGTTTTAAAATTATGTTTTAAAATGGACT
ATCATATGCTTACCGTAACTTGAAAGTATTTCGATTTCTTGGCTTTATATATCTTGTG
GAAAGGACGAAACACCCTCGAG

SEQ ID NO: 7

MiRNA DETARGETING SYSTEM FOR TISSUE SPECIFIC INTERFERENCE

This application claims priority benefit of U.S. Provisional Patent Application No. 62/566,966, filed Oct. 2, 2017, which is incorporated by reference herein in its entirety.

FIELD OF THE INVENTION

The present disclosure relates to a tissue-specific promoter system for expressing microRNA (miRNA) for RNA interference-based methods of gene therapy. In these systems, the miRNA will inhibit gene expression or replace natural miRNA expression using microRNA.

INCORPORATION BY REFERENCE OF THE SEQUENCE LISTING

This application contains, as a separate part of disclosure, a Sequence Listing in computer-readable form (Filename: 52375A_SeqListing.txt; 1,684,382 bytes—ASCII text file, created Oct. 1, 2018) which is incorporated by reference herein in its entirety.

BACKGROUND

RNA interference (RNAi) is a mechanism of gene regulation in eukaryotic cells that has been considered for the treatment of various diseases. RNAi refers to post-transcriptional control of gene expression mediated by microRNAs (miRNAs). Natural miRNAs are small (21-25 nucleotides), noncoding RNAs that share sequence homology and base-pair with 3' untranslated regions of cognate messenger RNAs (mRNAs), although regulation in coding regions may also occur. The interaction between the miRNAs and mRNAs directs cellular gene silencing machinery to degrade target mRNA and/or prevent the translation of the mRNAs. The RNAi pathway is summarized in Duan (Ed.), Section 7.3 of Chapter 7 in *Muscle Gene Therapy*, Springer Science+Business Media, LLC (2010).

As an understanding of natural RNAi pathways has developed, researchers have designed artificial miRNAs for use in regulating expression of target genes for treating disease. As described in Section 7.4 of Duan, supra, artificial miRNAs can be transcribed from DNA expression cassettes. The miRNA sequence specific for a target gene is transcribed along with sequences required to direct processing of the miRNA in a cell. Viral vectors such as adeno-associated virus have been used to deliver miRNAs to muscle [Fechner et al., *J. Mol. Med.*, 86: 987-997 (2008)].

Adeno-associated virus (AAV) is a replication-deficient parvovirus, the single-stranded DNA genome of which is about 4.7 kb in length including two 145 nucleotide inverted terminal repeat (ITRs). There are multiple serotypes of AAV. The nucleotide sequences of the genomes of the AAV serotypes are known. For example, the complete genome of AAV-1 is provided in GenBank Accession No. NC_002077; the complete genome of AAV-2 is provided in GenBank Accession No. NC_001401 and Srivastava et al., *J. Virol.*, 45: 555-564 {1983); the complete genome of AAV-3 is provided in GenBank Accession No. NC_1829; the complete genome of AAV-4 is provided in GenBank Accession No. NC_001829; the AAV-5 genome is provided in GenBank Accession No. AF085716; the complete genome of AAV-6 is provided in GenBank Accession No. NC_00 1862; at least portions of AAV-7 and AAV-8 genomes are provided in GenBank Accession Nos. AX753246 and AX753249, respectively; the AAV -9 genome is provided in Gao et al., *J. Virol.*, 78: 6381-6388 (2004); the AAV-10 genome is provided in *Mol. Ther.*, 13(1): 67-76 (2006); and the AAV-11 genome is provided in *Virology*, 330(2): 375-383 (2004). Cloning of the AAVrh.74 serotype is described in Rodino-Klapac., et al. *Journal of Translational Medicine* 5, 45 (2007). Isolation of the AAV-B 1 serotype is described in Choudhury et al., *Mol. Therap.* 24(7): 1247-57, 2016. Cis-acting sequences directing viral DNA replication (rep), encapsidation/packaging and host cell chromosome integration are contained within the AAV ITRs. Three AAV promoters (named p5, p19, and p40 for their relative map locations) drive the expression of the two AAV internal open reading frames encoding rep and cap genes. The two rep promoters (p5 and p19), coupled with the differential splicing of the single AAV intron (at nucleotides 2107 and 2227), result in the production of four rep proteins (rep 78, rep 68, rep 52, and rep 40) from the rep gene. Rep proteins possess multiple enzymatic properties that are ultimately responsible for replicating the viral genome. The cap gene is expressed from the p40 promoter and it encodes the three capsid proteins VP1, VP2, and VP3. Alternative splicing and non-consensus translational start sites are responsible for the production of the three related capsid proteins. A single consensus polyadenylation site is located at map position 95 of the AAV genome. The life cycle and genetics of AAV are reviewed in Muzyczka, *Current Topics in Microbiology and Immunology*, 158: 97-129 (1992).

AAV possesses unique features that make it attractive as a vector for delivering foreign DNA to cells, for example, in gene therapy. AAV infection of cells in culture is noncytopathic, and natural infection of humans and other animals is silent and asymptomatic. Moreover, AAV infects many mammalian cells allowing the possibility of targeting many different tissues in vivo. Moreover, AAV transduces slowly dividing and non-dividing cells, and can persist essentially for the lifetime of those cells as a transcriptionally active nuclear episome (extrachromosomal element). The AAV proviral genome is inserted as cloned DNA in plasmids, which makes construction of recombinant genomes feasible. Furthermore, because the signals directing AAV replication and genome encapsidation are contained within the ITRs of the AAV genome, some or all of the internal approximately 4.3 kb of the genome (encoding replication and structural capsid proteins, rep-cap) may be replaced with foreign DNA. To generate AAV vectors, the rep and cap proteins may be provided in trans. Another significant feature of AAV is that it is an extremely stable and hearty virus. It easily withstands the conditions used to inactivate adenovirus (56° to 65° C. for several hours), making cold preservation of AAV less critical. AAV may even be lyophilized. Finally, AAV-infected cells are not resistant to superinfection.

miRNA-based therapies, including miRNA inhibition and miRNA replacement, may be used to treat many diseases such as hepatitis C viral infection, muscular dystrophies, neurodegenerative diseases, peripheral neuropathies, chronic heart failure and post-myocardial infarction remodeling and cancers. In addition, miRNA directed regulation of gene expression may improve traditional gene therapy approaches in which the vector payload is a protein coding gene. Systemically delivered AAV vectors preferentially transduce the liver, resulting in high-level transgene expression in that organ if a liver-active promoter is used. As described in detail herein, the insertion of liver-specific miR-122 binding sites reduce transgene expression in the liver when a liver-specific promoter is used.

SUMMARY

The present disclosure provides for a system for tissue-specific expression of miRNA in vectors comprising detargeting miRNA binding sequences placed at various locations within the miRNA mature guide strand. The nucleic acid molecules of the disclosure comprise a tissue specific promoter and a miRNA mature guide strand comprising the corresponding binding site to detarget expression of the miRNA in a specific tissue. In particular, the disclosure provides for nucleic acid molecules comprising a tissue specific promoter sequence, mature guide strand of a miRNA comprising at least one detargeting sequence and 5-6 thymidines at the 5' end. In one example, the nucleic acid molecules have U6 promoter and a miRNA mature guide strand containing the miR-122 and miR-208 binding site to detarget expression of the miRNA in the liver and heart, respectively. In a proof-of-concept study, liver-specific miR-122 target sequences were inserted into AAV vectors carrying luciferase or LacZ reporter genes. In these vectors, ubiquitously active U6 promoters were used to drive transcription of both genes. AAV vectors lacking miR-122 sites resulted in extremely high levels of luciferase or LacZ expression in mouse livers, while transcription of the same genes was reduced 50- and 70-fold, respectively, when delivered by vectors carrying miR-122 binding sites in each respective coding gene. Such systems have not been employed for microRNA expression vectors (Reference PMID: 21150938).

The nucleic acid molecules of the disclosure comprise any tissue specific promoter. Exemplary tissue specific promoters include U6 promoter sequence, MHCK7 promoter sequence, CK6 promoter sequence, tMCK promoter sequence, CK5 promoter sequence, MCK promoter sequence, HAS promoter sequence, MPZ promoter sequence, desmin promoter sequence, APOA2 promoter sequence, hAAT promoter sequence, INS promoter sequence, IRS2 promoter sequence, MYH6 promoter sequence, MYL2 promoter sequence, TNNI3 promoter sequence, SYN1 promoter sequence, GFAP promoter sequence, NES promoter sequence, MBP promoter sequence, or TH promoter sequence.

The disclosure provides for nucleic acid molecules comprising an U6 promoter sequence and miRNA mature guide strand sequence comprising at least one detargeting sequence and 5-6 thymidines at the 5' end. The nucleic acid molecules of the disclosure comprise at least two detargeting sequences, at least three detargeting sequences, at least four detargeting sequences, at least five detargeting sequences or more. In addition to the tissue specific miRNA binding sites, the DNA nucleic acid sequence comprises a transcription termination signal for RNA polymerase III, which comprises five thymidines at the 5' end or comprises six thymidines at the 5' end. When transcribed into RNA, these thymidines are added to the transcript as uracils.

The "detargeting sequence" is the binding site for any tissue-specific miRNA that is desired to be inhibited in a tissue. For example, the disclosure provides nucleic acid sequences wherein the detargeting sequence is the binding site for any natural miRNA, for example miR-122, miR-208, miR-1, miR-206, miR-133, miR-29a, miR-29b or miR-29c. Exemplary miRNA sequences are provided in Table 2.

The nucleic acid molecules of the disclosure comprise any miRNA mature guide strand that will inhibit expression of a gene of interest. For example, the nucleic acid molecules comprise the miRNA mature guide strand of miDUX4, miRNA-92, miRNA-17, miRNA-18a, miRNA-19a, miRNA-20a, miRNA-19b-1, mi-RNA-26a, miRNA-122, miRNA-126, miRNA-335, let-7a and let-7b, miRNA-34 (miR-34a), miRNA-10b, miRNA-208, miRNA-499, miRNA-195, miRNA-29a, miRNA-29b, or miRNA-29c. The nucleic acid molecules comprise any of the miRNA mature guide strands set out as SEQ ID NOS: 10-10912. The nucleic acid molecules of the disclosure comprise the mature guide strand of miDUX4 having the nucleic acid sequence of SEQ ID NO: 1 (miDUX4-1; mi405) or SEQ ID NO: 2 (miDUX-4-2; mi1155).

The nucleic acid molecule of the disclosure comprise the mature guide stand of a miRNA comprising a nucleotide sequence of any human miRNA such as those set out in the miRBase: the microRNA database websites (miRBase.org) or Table 2. The sequences provided in the miRBase: the microRNA database are incorporated by references herein. Exemplary miRNA include but are not limited to mir450 (SEQ ID NO: 10973), mi1155mi70 (SEQ ID NO: 8482), mi180 (SEQ ID NO: 8372), mi181(SEQ ID NO: 8371), mi182 (SEQ ID NO: 8370), mi185 (SEQ ID NO: 8367), mi186 (SEQ ID NO: 8366), mi187 (SEQ ID NO: 8365), mi333 (SEQ ID NO: 8219), mi334 (SEQ ID NO: 8218), mi400 (SEQ ID NO: 8152), mi405 (SEQ ID NO: 8147), mi407 (SEQ ID NO: 8145), mi1155 (SEQ ID NO: 7397), mi1156 (SEQ ID NO: 7396), mi1157 (SEQ ID NO: 7395), mi1308 (SEQ ID NO: 7108), mi1309 (SEQ ID NO: 7107), mi1310 (SEQ ID NO: 7106), mi1420 (SEQ ID NO: 6633), mi1422 (SEQ ID NO: 6631), mi1431 (SEQ ID NO: 6622), mi1434 (SEQ ID NO: 6619), mi1444 (SEQ ID NO: 6609), mi1445 (SEQ ID NO: 6608), mi1485 (SEQ ID NO: 6568), mi1492 (SEQ ID NO: 6561), mi1493 (SEQ ID NO: 6560), mi1519 ((SEQ ID NO: 10971) or mi1520 (SEQ ID NO: 10972). These sequences fold similarly to mature guide stands of mi405 and mi1155. Therefore, the disclosure provides for nucleic acid molecules in which the mir-208 bind site sequence (SEQ ID NO: 5 or SEQ ID NO: 66) and/or the mir-122 binding site sequence (SEQ ID NO: 6 or SEQ ID NO: 67) may be inserted into the loop of any of the foregoing mature guide strand at locations similar to those set out in the sequences in Table 1.

In an exemplary embodiment, the nucleic acid molecules of the disclosure comprise a U6 promoter having the nucleic acid sequence of SEQ ID NO: 3, the mature guide strand of miDUX4 with the miR-122 and/or miR-208 binding site within the loop of the mature guide strand or at 5' or 3' end of the mature guide strand and 5-6 thymidines. Exemplary nucleic acid molecules comprise the miRNA mature guide strand of miDUX4 and at least one detargeting sequence, e.g. miR-122 (SEQ ID NO: 5) or miR-208 (SEQ ID NO: 6) binding sites inserted within the loop of the mature guide strand, at the 5' end of the mature guide strand or at the 3' end of the mature guide strand, such as the nucleic acid sequence set out as any one of SEQ ID NOS: 10913-10968.

The disclosure provides for nucleic acid molecule comprising the nucleic acid sequence of any one of SEQ ID NOS: 1, 2 or 10913-10968.

In another embodiment, the disclosure provides for recombinant adeno-associated virus (AAV) comprising any of the nucleic acid molecules of the disclosure . The AAV can be any serotype, for example AAV-B1, AAVrh.74, AAV1, AAV2, AAV3, AAV4, AAVS, AAV6, AAV7, AAV8, AAV9, AAV-10, AAV-11, AAV-12 and AAV-13. Production of pseudotyped rAAV is disclosed in, for example, WO 01/83692. Other types of rAAV variants, for example rAAV with capsid mutations, are also contemplated. See, for example, Marsic et al., Molecular Therapy, 22(11): 1900-1909 (2014). The disclosure also provides for compositions comprising any of the disclosed AAV . In addition, the disclosure provides for recombinant AAV vectors that are self-complementary AAV vectors.

In another embodiment, the disclosure provides for methods of inhibiting expression of a gene in a cell comprising contacting the cell with a vector comprising the any of the nucleic acid molecules of the. For example, the disclosure provide for methods of inhibiting expression of a gene in a cell comprising contacting the cell with a recombinant AAV comprising any of the nucleic acid molecules of the disclosure. Other embodiments of the disclosure utilize other vectors or plasmids to deliver the disclosed nucleic acid molecules, e.g. other viral vectors such as adenovirus, retrovirus, lentivirus, equine-associated virus, alphavirus, pox viruses, herpes virus, polio virus, sindbis virus and vaccinia viruses, to deliver the nucleic acid molecules of the disclosure.

The disclosure also provides for methods of inhibiting expression of the DUX4 gene in a cell comprising contacting the cell with a recombinant AAV comprising any of the disclosed nucleic acid molecules or any of the disclosed compositions. For example, the method is carried out with a nucleic acid molecule of the disclosure comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule of the disclosure comprises the nucleic acid sequence of any one of SEQ ID NOS: 10913-10968.

The disclosure provides for a use of a recombinant AAV comprising any of the disclosed nucleic acid molecules or a disclosed composition for the preparation of a medicament for inhibiting expression of the DUX4 gene in a cell. The AAV or compositions utilized to prepare the medicament comprise a nucleic acid molecule comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule comprises the nucleic acid sequence of any one of SEQ ID NOS: 10913-10968.

The disclosure also provides for a composition for the use of a recombinant AAV comprising any of the disclosed nucleic acid molecules or a disclosed composition for inhibiting expression of the DUX4 gene in a cell. The AAV or compositions utilized to prepare the medicament comprise a nucleic acid molecule comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule comprises the nucleic acid sequence of any one of SEQ ID NOS: 10913-10968.

The disclosure further provides for methods of delivering DUX4 miRNA-encoding DNA to the skeletal muscle of an animal in need thereof, comprising administering to the animal a recombinant AAV comprising the nucleic acid sequence of any one of SEQ ID NOS: 10913-10968.

The disclosure also provides for use of a recombinant AAV comprising a disclosed nucleic acid sequence for delivering DUX4 miDNA-encoding nucleic acid molecule to the skeletal muscle of an animal in need thereof. The disclosure provides for compositions comprising the nucleic acid sequence of any one of SEQ ID NOS: 10913-10968 for delivering DUX4 miDNA-encoding nucleic acid molecule to the skeletal muscle of an animal in need thereof.

In another embodiment, the disclosure provides for methods of treating facioscapulohumeral muscular dystrophy comprising administering a recombinant adeno-associated virus comprising any of the nucleic acid molecules or any of the compositions of the disclosure. For example, the method is carried out with a disclosed nucleic acid molecule comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule having the nucleic acid sequence of any one of SEQ ID NOS: 10913-10968.

In any of the methods of the disclosure, the recombinant AAV is administered by intramuscular injection, transdermal transport or injection into the blood stream The disclosure provides for a use of a recombinant AAV comprising any disclosed nucleic acid molecule or a disclosed composition for the preparation of a medicament for treating facioscapulohumeral muscular dystrophy. The AAV or compositions utilized to prepare the medicament comprise a nucleic acid molecule of the comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule having the nucleic acid sequence of any one of SEQ ID NOS: 10913-10968.

In any of the uses of the disclosure, the medicament is formulated for administration by intramuscular injection, transdermal transport or injection into the blood stream.

The disclosure also provides for a composition for the use of a recombinant AAV comprising any disclosed nucleic acid molecules or a disclosed composition for treating facioscapulohumeral muscular dystrophy. The AAV or compositions utilized to prepare the medicament comprise a nucleic acid molecule comprising the U6 promoter, the mature guide strand of miDUX4 with the miR-122 and/or miR-208 binding site inserted within the loop of the mature guide strand or at 5' or 3' end of the mature guide strand and 5-6 thymidines or the nucleic acid molecule having the nucleic acid sequence of any one of SEQ ID NOS: 10913-10968 The compositions of the disclosure are formulated for administration by intramuscular injection, transdermal transport or injection into the blood stream.

DETAILED DESCRIPTION

The present disclosure provides for a system for tissue-specific specific expression of miRNA that results in tissue-specific inhibition of a gene of interest. The system comprises a promoter for tissue specific expression of a mature guide strand of a miRNA comprising detargeting sequences inserted within the mature guide strand to detarget expression of the that miRNA or gene of interest.

One example of the detargeting systems of the disclosure is the U6 promoter system for tissue-specific specific expression of miRNA. The U6 promoter system is a nucleic acid molecule comprising the U6 promoter sequence, the mature guide strand of a miRNA with detargeting sequences inserted within the mature guide strand sequence. For example, the binding site for the liver specific miR-122 and/or the binding site for the heart specific miR-208 inserted within the loop of mature guide strand of a miRNA or at the 5' or 3' end of the mature guide strand of a miRNA to detarget expression of the miRNA in the liver and heart, respectively.

The U6 promoter system provides, miRNA-guided inhibition of a target gene or replacement of a miRNA which may result in inhibition of a target gene or replacement of an under-transcribed miRNA. The wild type U6 promoter (U6-1) is set out as SEQ ID NO: 3.

Detargeting miRNA Sequence Expression

The promoter system of the disclosure is a nucleic acid molecule comprising a mature guide strand of a miRNA in which binding sites for detargeting miRNAs are inserted within the loop of the mature guide strand of the miRNA or at the 5' or 3' end of the mature guide stand of the miRNA. This system may be used with any tissue specific promoter or gene expression control element and any miRNA sequences. For example, in order to promote expression of miRNA sequence in skeletal muscle and to detarget expression of the miRNA in liver and heart tissue, the nucleic acid molecule comprises the mature guide stand of the miRNA in which the binding sites for liver specific miR-122 and/or the binding site for heart specific miR-208 are inserted within the loop of the mature guide strand or at the 5' or 3' end of the mature guide strand of the miRNA . The nucleotide sequence of the binding site for miRNA-122 is set out as SEQ ID NO: 5, and the nucleotide sequence of the binding site for miRNA-208 is set out as SEQ ID NO: 6.

Examples of muscle-specific promoters or muscle-specific control elements include a human skeletal actin gene element, cardiac actin gene element, myocyte-specific enhancer binding factor mef, muscle creatine kinase (MCK), truncated MCK (tMCK), myosin heavy chain (MHC), hybrid α-myosin heavy chain enhancer-/MCK enhancer-promoter (MHCK7), creatine kinase 5 (CK5) promoter, creatine kinase 6 (CK6) promoter, C5-12, murine creatine kinase enhancer element, skeletal fast-twitch troponin c gene element, desmin promoter sequence, myosin heavy chain 6 (MYH6) promoter, myosin light chain 2 (MYL2) promoter, slow-twitch cardiac troponin c gene element, the slow-twitch troponin i gene element, hypoxia-inducible nuclear factors, steroid-inducible element and glucocorticoid response element (gre).

Examples of cardiac-specific promoters include myosin heavy chain 6, cardiac muscle, alpha promoter (Myh6 or αMHC), myosin light chain 2, regulatory cardiac, slow promoter ($MYL_2$ or MLC-2v), troponin I type 3 promoter ($TNNI_3$ or cTnI), natriuretic peptide precursor A promoter or atrial natriuretic factor promoter (NPPA or ANF) and solute carrier family 8 (sodium/calcium exchanger) member 1 promoter ($Slc8_{a1}$ or Ncx1).

Examples of liver-specific promoters include apolipoprotein A-II promoter ($APOA_2$), Serpin peptidase inhibitor promoter, clade A (alpha-1 antiproteinase, antitrypsin), member 1 promoter, human α1 anti-trypsin promoter (hAAT), apolipoprotein A-I (APO-A1), and cytochrome P450 promoter.

Examples of pancreas-specific promoters include insulin promoter (INS), insulin receptor substrate 2 promoter ($IRS_2$), pancreatic and duodenal homeobox 1 promoter (Pdx1), aristaless-like homoeobox 3 promoter (Alx3), and pancreatic polypeptide promoter (Ppy).

Examples of central nervous system specific promoters include synapsin I promoter (SYN1 or hSYN), glial fibrillary acidic protein promoter (GFAP), internexin neuronal intermediate filament protein, alpha promoter or α-internexin promoter (INA), nestin promoter (NES), myelin-associated oligodendrocyte basic protein promoter (MOBP), myelin basic protein promoter (MBP), myelin protein zero (MPZ) promoter, tyrosine hydroxylase promoter (TH) and forkhead box A2 promoter ($FOXA_2$).

Examples of skin cell specific promoters include filaggrin promoter (FLG), kerarin 14 promoter ($K_{14}$), and transglataminase 3 promoter ($TGM_3$).

Examples of immune system cell specific promoters include integrin, alpha M promoter (ITGAM) and complement component 3 receptor 3 subunit promoter ($CD_{11}B$)

Examples of urogenital cell specific promoters include probasin promoter (Pbsn), uroplakin 2 promoter (Upk2), spermine binding protein promoter (Sbp) and Fer-1-like 4 promoter (Fer114). An example of an endothelial cell specific promoter is endoglin promoter (ENG)

If detargeting expression of a miRNA in skeletal muscle is desired, binding sites for miR-1, miR-206 or miR-133 are inserted within the loop of the mature guide strand of the miRNA or at the 5' or 3' end of the mature guide strand of the miRNA.

If detargeting expression in tissues other than skeletal muscle, liver and/or heart is desired, binding sites for different miRNA transcripts may be inserted within the mature guide strand of the miRNA. For example, the miR-142 binding site may be used to detarget transcript expression in hematopoietic cells. Binding sites for miR-29a, miR-29b, and/or miR-29c may be used to detarget miRNA expression in normal tissues and to target miRNA expression in tumor tissue.

The miRNA binding sequences that may be used for detargeting miRNA expression in a tissue are collectively denoted herein as "detargeting sequences." The nucleic acid sequence of the disclosure comprises at least one copy of a detargeting sequence, or at least two copies of a detargeting sequence, or at least three copies of a detargeting sequence, or at least four copies of the detargeting sequence or at least five copies of a detargeting sequence. The nucleic acid molecule of the disclosure comprises 1-5 copies of a detargeting sequence, or 1-4 copies of a detargeting sequence, or 1-3 copies of the detargeting sequence or 1-2 copies of the detargeting sequence, or 2-5 copies of the detargeting sequence, 2-4 copies of a detargeting sequence, or 2-3 copies of a detargeting sequence, or 3-5 copies of a detargeting sequence, or 3-4 copies of a detargeting sequence, or 4-5 copies of a detargeting sequence.

The detargeting sequences may be inserted within the loop of the mature guide strand of the miRNA or at the 5' or 3' end of the mature guide strand of the miRNA. Exemplary locations for insertion of the detargeting sequences are set out in FIG. 4, and exemplary nucleic acids comprising the mature guide strand of miDUX4 (mi405 (SEQ ID NO: 10973) or mi1155 (SEQ ID NO: 10974) and the miR-122 binding site (SEQ ID NO: 5 or SEQ ID NO: 66) or the miR-208 binding site (SEQ ID NO: 6 or SEQ ID NO: 67) are provided in Table 1 below.

There are two miR-208 sequences in the human and mouse genome (miR-208a and miR-208b). To avoid a run of 5 U's (pol III promoter termination sequence), in the following exemplary sequences, a single base in the binding site was mutated to a "c" (lower-case bolded "c"). This change was included because it creates a perfect binding site for mir-208b, but will have a mismatch with mir-208a.

TABLE 1

| SEQ ID NO: | miDUX4 | miR binding site (underlined) | Location of binding site | Nucleotide Sequence (lower case letter - spacers to facilitate proper folding of the pre-miRNA stem) |
|---|---|---|---|---|
| 10913 | mi405 | miR-122 | Loop | CTCGAGTGAGCGATCCAGGATTCAGATCTGGTTTCTATT TAGTGTGATAATGGTGTTTAAACCAGATCTGAATCCTGG ACTGCCTACTAGT |
| 10914 | mi1155 | miR-122 | Loop | CTCGAGTGAGCGACAGGCGCAACCTCTCCTAGAATATTT AGTGTGATAATGGTGTTTCTAGGAGAGGTTGCGCCTGC TGCCTACTAGT |
| 10915 | mi405 | miR-122 | 5' end | CTCGAGTATTTAGTGTGATAATGGTGTTTctcggcTGAGC GATCCAGGATTCAGATCTGGTTTCTGAAAGCCACAGATG GGAAACCAGATCTGAATCCTGGACTGCCTACTAGT |
| 10916 | mi1155 | miR-122 | 5' end | CTCGAGTATTTAGTGTGATAATGGTGTTTctcggcTGAGC GACAGGCGCAACCTCTCCTAGAACTGTAAAGCCACAGAT GGGTTCTAGGAGAGGTTGCGCCTGCTGCCTACTAGT |
| 10917 | mi405 | miR-122 | 3' end | CTCGAGTGAGCGATCCAGGATTCAGATCTGGTTTCTGAA AGCCACAGATGGGAAACCAGATCTGAATCCTGGACTGC CTactagaTATTTAGTGTGATAATGGTGTTTACTAGT |
| 10918 | mi1155 | miR-122 | 3' end | CTCGAGTGAGCGACAGGCGCAACCTCTCCTAGAACTGTA AAGCCACAGATGGGTTCTAGGAGAGGTTGCGCCTGCTG CCTactagaTATTTAGTGTGATAATGGTGTTTACTAGT |
| 10919 | mi405 | miR-208 | Loop | CTCGAGTGAGCGATCCAGGATTCAGATCTGGTTTCTACG AGCcTTTTGCTCGTCTTATGGAAACCAGATCTGAATCCT GG ACTGCCTACTAGT |
| 10920 | mi1155 | miR-208 | Loop | CTCGAGTGAGCGACAGGCGCAACCTCTCCTAGAACTAC GAGCcTTTTGCTCGTCTTATGGTTCTAGGAGAGGTTGCG CCTGCTGCCTACTAGT |
| 10921 | mi405 | miR-208 | 5' end | CTCGAGACGAGCcTTTTGCTCGTCTTATctcggcTGAGCG ATCCAGGATTCAGATCTGGTTTCTGTAAAGCCACAGATG GGAAACCAGATCTGAATCCTGGACTGCCTACTAGT |
| 10922 | mi1155 | miR-208 | 5' end | CTCGAGACGAGCTTTTTGCTCGTCTTATctcggcTGAGCG ACAGGCGCAACCTCTCCTAGAACTGTAAAGCCACAGATG GGTTCTAGGAGAGGTTGCGCCTGCTGCCTACTAGT |
| 10923 | mi405 | miR-208 | 3' end | CTCGAGTGAGCGATCCAGGATTCAGATCTGGTTTCTGTA AAGCCACAGATGGGAAACCAGATCTGAATCCTGGACTG CCTactagaACGAGCcTTTTGCTCGTCTTATACTAGT |
| 10924 | mi1155 | miR-208 | 3' end | CTCGAGTGAGCGACAGGCGCAACCTCTCCTAGAACTGTA AAGCCACAGATGGGTTCTAGGAGAGGTTGCGCCTGCTG CCTactagaACGAGCcTTTTGCTCGTCTTATACTAGT |
| 10925 | mi405 | 5' miR-122, 3' miR-208 | | CTCGAGTATTTAGTGTGATAATGGTGTTTctcggcTGAGC GATCCAGGATTCAGATCTGGTTTCTGTAAAGCCACAGAT GGGAAACCAGATCTGAATCCTGGACTGCCTactagaACG AGCcTTTTGCTCGTCTTATACTAGT |
| 10926 | mi1155 | 5' miR-122, 3' miR-208 | | CTCGAGTATTTAGTGTGATAATGGTGTTTctcggcGAGC GACAGGCGCAACCTCTCCTAGAACTGTAAAGCCACAGAT GGGTTCTAGGAGAGGTTGCGCCTGCTGCCTactagaACG AGCcTTTTGCTCGTCTTATACTAGT |
| 10927 | mi405 | miR-122, miR-208 | 5' (both) | CTCGAGTATTTAGTGTGATAATGGTGTTTACGAGCcTTT TGCTCGTCTTATctcggcTGAGCGATCCAGGATTCAGATCT GGTTTCTGTAAAGCCACAGATGGGAAACCAGATCTGAA TCCTGGACTGCCTACTAGT |
| 10928 | mi1155 | miR-122, miR-208 | 5' (both) | CTCGAGTATTTAGTGTGATAATGGTGTTTACGAGCcTTT TGCTCGTCTTATctcggcTGAGCGACAGGCGCAACCTCTC CTAGAACTGTAAAGCCACAGATGGGTTCTAGGAGAGGT TGCGCCTGCTGCCTACTAGT |
| 10929 | mi405 | miR-122, miR-208 | 3' (both) | CTCGAGTGAGCGATCCAGGATTCAGATCTGGTTTCTGTA AAGCCACAGATGGGAAACCAGATCTGAATCCTGGACTG CCTactagaTATTTAGTGTGATAATGGTGTTTACGAGCcT TTTGCTCGTCTTATACTAGT |
| 10930 | mi1155 | miR-122, miR-208 | 3' (both) | CTCGAGTGAGCGACAGGCGCAACCTCTCCTAGAACTGTA AAGCCACAGATGGGTTCTAGGAGAGGTTGCGCCTGCTG |

TABLE 1-continued

| SEQ ID NO: | miDUX4 | miR binding site (underlined) | Location of binding site | Nucleotide Sequence (lower case letter - spacers to facilitate proper folding of the pre-miRNA stem) |
|---|---|---|---|---|
| | | | | CCTactagaTATTTAGTGTGATAAATGGTGTTTACGAGCcTTTTGCTCGTCTTATACTAGT |
| 10931 | mi405 | miR-122 loop, 5' miR-208 | | CTCGAGACGAGCcTTTTGCTCGTCTTATctcgggTGAGCGATCCAGGATTCAGATCTGGTTTCTTATTTAGTGTGATAATGGTGTTTGGAAACCAGATCTGAATCCTGGACTGCCTACTAGT |
| 10932 | mi1155 | miR-122 loop, 5' miR-208 | | CTCGAGACGAGCcTTTTGCTCGTCTTATctcgggTGAGCGACAGGCGCAACCTCTCCTAGAACTTATTTAGTGTGATAATGGTGTTTGGTTCTAGGAGAGGTTGCGCCTGCTGCCTACTAGT |
| 10933 | mi405 | miR-122 Loop, 3' miR-208 | | CTCGAGTGAGCGATCCAGGATTCAGATCTGGTTTCTTATTTAGTGTGATAATGGTGTTTGGAAACCAGATCTGAATCCTGGACTGCCTactagaACGAGCcTTTTGCTCGTCTTATACTAGT |
| 10934 | mi1155 | miR-122 Loop, 3' miR-208 | | CTCGAGTGAGCGACAGGCGCAACCTCTCCTAGAACTTATTTAGTGTGATAATGGTGTTTGGTTCTAGGAGAGGTTGCCTGCTGCCTactagaACGAGCcTTTTGCTCGTCTTATACTAGT |
| 10935 | mi405 | miR-208 loop, 5' miR-122 | | CTCGAGTATTTAGTGTGATAATGGTGTTctcgggTGAGCGATCCAGGATTCAGATCTGGTTTCTACGAGCcTTTTGCTCGTCTTATGGAAACCAGATCTGAATCCTGGACTGCCTACTAGT |
| 10936 | mi1155 | miR-208 loop, 5' miR-122 | | CTCGAGTATTTAGTGTGATAATGGTGTTTctcgggTGAGCGACAGGCGCAACCTCTCCTAGAACTACGAGCcTTTTGCTCGTCTTATGGTTCTAGGAGAGGTTGCGCCTGCTGCCTACTAGT |
| 10937 | mi405 | miR-208 loop, 3' miR-122 | | CTCGAGTGAGCGATCCAGGATTCAGATCTGGTTTCTACGAGCcTTTTGCTCGTCTTATGGAAACCAGATCTGAATCCTGGACTGCCTactagaTATTTAGTGTGATAATGGTGTTTACTAGT |
| 10938 | mi1155 | miR-208 loop, 3' miR-122 | | CTCGAGTGAGCGACAGGCGCAACCTCTCCTAGAACTACGAGCcTTTTGCTCGTCTTATGGTTCTAGGAGAGGTTGCGCCTGCTGCCTactagaTATTTAGTGTGATAATGGTGTTTACTAGT |
| 10939 | mi405 | miR-122 / miR-122 | Loop (both) | CTCGAGTGAGCGATCCAGGATTCAGATCTGGTTTCTTTTAGTGTGATAATGGTGTTTGACGAGCTTTTTGCTCGTCTTATGGAAACCAGATCTGAATCCTGGACTGCCTACTAGT |
| 10940 | mi1155 | miR-122 / miR-122 | Loop (both) | CTCGAGTGAGCGACAGGCGCAACCTCTCCTAGAACTTTTAGTGTGATAATGGTGTTTGACGAGCTTTTTGCTCGTCTTATGGTTCTAGGAGAGGTTGCGCCTGCTGCCTACTAGT |
| 10941 | mi405 | miR-122 | Loop | CUCGAGUGAGCGAUCCAGGAUUCAGAUCUGGUUUCUUAUUUAGUGUGAUAAUGGUGUUUAAACCAGAUCUGAAUCCUGGACUGCCUACUAGU |
| 10942 | mi1155 | miR-122 | Loop | CUCGAGUGAGCGACAGGCGCAACCUCUCCUAGAAUAUUUAGUGUGAUAAUGGUGUUUCUAGGAGAGGUUGCGCCUGCUGCCUACUAGU |
| 10943 | mi405 | miR-122 | 5' end | CUCGAGUAUUUAGUGUGAUAAUGGUGUUUcUcgggUGAGCGAUCCAGGAUUCAGAUCUGGUUUCUGAAAGCCACAGAUGGGAAACCAGAUCUGAAUCCUGGACUGCCUACUAGU |
| 10944 | mi1155 | miR-122 | 5' end | CUCGAGUAUUUAGUGUGAUAAUGGUGUUUcUcgggUGAGCGACAGGCGCAACCUCUCCUAGAACUGUAAAGCCACAGAUGGGUUCUAGGAGAGGUUGCGCCUGCUGCCUACUAGU |
| 10945 | mi405 | miR-122 | 3' end | CUCGAGUGAGCGAUCCAGGAUUCAGAUCUGGUUUCUGAAAGCCACAGAUGGGAAACCAGAUCUGAAUCCUGGACUGCCUacUagaUAUUUAGUGUGAUAAUGGUGUUUACUAGU |

TABLE 1-continued

| SEQ ID NO: | miDUX4 | miR binding site (underlined) | Location of binding site | Nucleotide Sequence (lower case letter - spacers to facilitate proper folding of the pre-miRNA stem) |
|---|---|---|---|---|
| 10946 | mi1155 | miR-122 | 3' end | CUCGAGUGAGCGACAGGCGCAACCUCUCCUAGAACUG UAAAGCCACAGAUGGGUUCUAGGAGAGGUUGCGCCU GCUGCCUacUagaUAUUUAGUGUGAUAAUGGGUGUUU ACUAGU |
| 10947 | mi405 | miR-208 | Loop | CUCGAGUGAGCGAUCCAGGAUUCAGAUCUGGUUUCU ACGAGCcUUUUGCUCGUCUUAUGGAAACCAGAUCUG AAUCCUGGACUGCCUACUAGU |
| 10948 | mi1155 | miR-208 | Loop | CUCGAGUGAGCGACAGGCGCAACCUCUCCUAGAACUA CGAGCcUUUUGCUCGUCUUAUGGUUCUAGGAGAGG UUGCGCCUGCUGCCUACUAGU |
| 10949 | mi405 | m i R-208 | 5' end | CUCGAGACGAGCcUUUUGCUCGUCUUAUcUcgggUGA GCGAUCCAGGAUUCAGAUCUGGUUUCUGUAAAGCCA CAGAUGGGAAACCAGAUCUGAAUCCUGGACUGCCUAC UAGU |
| 10950 | mi405 | miR-208 | 5' end | CUCGAGACGAGCUUUUUGCUCGUCUUAUcUcgggUGA GCGACAGGCGCAACCUCUCCUAGAACUGUAAAGCCAC AGAUGGGUUCUAGGAGAGGUUGCGCCUGCUGCCUAC UAGU |
| 10951 | mi405 | miR-208 | 3' end | CUCGAGUGAGCGAUCCAGGAUUCAGAUCUGGUUUCU GUAAAGCCACAGAUGGGAAACCAGAUCUGAAUCCUG GACUGCCUacUagaACGAGCcUUUUGCUCGUCUUAUA CUAGU |
| 10952 | mi1155 | miR-208 | 3' end | CUCGAGUGAGCGACAGGCGCAACCUCUCCUAGAACUG UAAAGCCACAGAUGGGUUCUAGGAGAGGUUGCGCCU GCUGCCUacUagaACGAGCcUUUUGCUCGUCUUAUAC UAGU |
| 10953 | mi405 | 5' miR-122, 3' miR-208 | | CUCGAGUAUUUAGUGUGAUAAUGGGUGUUUcUcgggU GAGCGAUCCAGGAUUCAGAUCUGGUUUCUGUAAAGC CACAGAUGGGAAACCAGAUCUGAAUCCUGGACUGCCU acUagaACGAGCcUUUUGCUCGUCUUAUACUAGU |
| 10954 | mi1155 | 5' miR-122, 3' miR-208 | | CUCGAGUAUUUAGUGUGAUAAUGGGUGUUUcUcgggU GAGCGACAGGCGCAACCUCUCCUAGAACUGUAAAGCC ACAGAUGGGUUCUAGGAGAGGUUGCGCCUGCUGCCU acUagaACGAGCcUUUUGCUCGUCUUAUACUAGU |
| 10955 | mi405 | miR-122, miR-208 | 5' (both) | CUCGAGUAUUUAGUGUGAUAAUGGGUGUUUACGAGC cUUUUGCUCGUCUUAUcUcgggUGAGCGAUCCAGGAU UCAGAUCUGGUUUCUGUAAAGCCACAGAUGGGAAAC CAGAUCUGAAUCCUGGACUGCCUACUAGU |
| 10956 | mi1155 | miR-122, miR-208 | 5' (both) | CUCGAGUAUUUAGUGUGAUAAUGGGUGUUUACGAGC cUUUUGCUCGUCUUAUcUcgggUGAGCGACAGGCGCA ACCUCUCCUAGAACUGUAAAGCCACAGAUGGGUUCUA GGAGAGGUUGCGCCUGCUGCCUACUAGU |
| 10957 | mi405 | miR-122, miR-208 | 3' (both) | CUCGAGUGAGCGAUCCAGGAUUCAGAUCUGGUUUCU GUAAAGCCACAGAUGGGAAACCAGAUCUGAAUCCUG GACUGCCUacUagaUAUUUAGUGUGAUAAUGGGUGUU UACGAGCcUUUUGCUCGUCUUAUACUAGU |
| 10958 | mi1155 | miR-122, miR-208 | 3' (both) | CUCGAGUGAGCGACAGGCGCAACCUCUCCUAGAACUG UAAAGCCACAGAUGGGUUCUAGGAGAGGUUGCGCCU GCUGCCUacUagaUAUUUAGUGUGAUAAUGGGUGUUU ACGAGCcUUUUGCUCGUCUUAUACUAGU |
| 10959 | mi405 | miR-122 Loop, 5' miR-208 | | CUCGAGACGAGCcUUUUGCUCGUCUUAUcUcgggUGA GCGAUCCAGGAUUCAGAUCUGGUUUCUUAUUUAGU GUGAUAAUGGGUGUUUGGAAACCAGAUCUGAAUCCU GGACUGCCUACUAGU |
| 10960 | mi1155 | miR-122 Loop, 5' miR-208 | | CUCGAGACGAGCcUUUUGCUCGUCUUAUcUcgggUGA GCGACAGGCGCAACCUCUCCUAGAACUUAUUUAGUG UGAUAAUGGGUGUUUGGUUCUAGGAGAGGUUGCGCC UGCUGCCUACUAGU |

TABLE 1-continued

| SEQ ID NO: | miDUX4 | miR binding site (underlined) | Location of binding site | Nucleotide Sequence (lower case letter - spacers to facilitate proper folding of the pre-miRNA stem) |
|---|---|---|---|---|
| 10961 | mi405 | miR-122 Loop, 3' miR-208 | | CUCGAGUGAGCGAUCCAGGAUUCAGAUCUGGUUUCU UAUUUAGUGUGAUAAUGGUGUUUGGAAACCAGAUC UGAAUCCUGGACUGCCUacUagaACGAGCcUUUUGCU CGUCUUAUACUAGU |
| 10962 | mi1155 | miR-122 Loop, 3' miR-208 | | CUCGAGUGAGCGACAGGCGCAACCUCUCCUAGAACUU AUUUAGUGUGAUAAUGGUGUUUGGUUCUAGGAGA GGUUGCGCCUGCUGCCUacUagaACGAGCcUUUUGCU CGUCUUAUACUAGU |
| 10963 | mi405 | miR-208 Loop, 5' miR-122 | | CUCGAGUAUUUAGUGUGAUAAUGGUGUUUcUcgggU GAGCGAUCCAGGAUUCAGAUCUGGUUUCUACGAGCc UUUUGCUCGUCUUAUGGAAACCAGAUCUGAAUCCUG GACUGCCUACUAGU |
| 10964 | mi1155 | miR-208 loop, 5' miR-122 | | CUCGAGUAUUUAGUGUGAUAAUGGUGUUUcUcgggU GAGCGACAGGCGCAACCUCUCCUAGAACUACGAGCcU UUUGCUCGUCUUAUGGUUCUAGGAGAGGUUGCGCC UGCUGCCUACUAGU |
| 10965 | mi405 | miR-208 loop, 3' miR-122 | | CUCGAGUGAGCGAUCCAGGAUUCAGAUCUGGUUUCU ACGAGCcUUUUGCUCGUCUUAUGGAAACCAGAUCUG AAUCCUGGACUGCCUacUagaUAUUUAGUGUGAUAA UGGUGUUUACUAGU |
| 10966 | mi1155 | miR-208 loop, 3' miR-122 | | CUCGAGUGAGCGACAGGCGCAACCUCUCCUAGAACUA CGAGCcUUUUGCUCGUCUUAUGGUUCUAGGAGAGG UUGCGCCUGCUGCCUacUagaUAUUUAGUGUGAUAA UGGUGUUUACUAGU |
| 10967 | mi405 | miR-122 miR-122 | Loop (both) | CUCGAGUGAGCGAUCCAGGAUUCAGAUCUGGUUUCU UUUAGUGUGAUAAUGGUGUUUGACGAGCUUUUUG CUCGUCUUAUGGAAACCAGAUCUGAAUCCUGGACUG CCUACUAGU |
| 10968 | mi1155 | miR-122 miR-122 | Loop (both) | CUCGAGUGAGCGACAGGCGCAACCUCUCCUAGAACUU UUAGUGUGAUAAUGGUGUUUGACGAGCUUUUUGC UCGUCUUAUGGUUCUAGGAGAGGUUGCGCCUGCUG CCUACUAGU |

The mature guide stand of a miRNA comprising a nucleotide sequence of mi70 (SEQ ID NO: 8482), mi180 (SEQ ID NO: 8372), mi181(SEQ ID NO: 8371), mi182 (SEQ ID NO: 8370), mi185 (SEQ ID NO: 8367), mi186 (SEQ ID NO: 8366), mi187 (SEQ ID NO: 8365), mi333 (SEQ ID NO: 8219), mi334 (SEQ ID NO: 8218), mi400 (SEQ ID NO: 8152), mi405 (SEQ ID NO: 8147), mi407 (SEQ ID NO: 8145), mi1155 (SEQ ID NO: 7397), mi1156 (SEQ ID NO: 7396), mi1157 (SEQ ID NO: 7395), mi1308 (SEQ ID NO: 7108), mi1309 (SEQ ID NO: 7107), mi1310 (SEQ ID NO: 7106), mi1420 (SEQ ID NO: 6633), mi1422 (SEQ ID NO: 6631), mi1431 (SEQ ID NO: 6622), mi1434 (SEQ ID NO: 6619), mi1444 (SEQ ID NO: 6609), mi1445 (SEQ ID NO: 6608), mi1485 (SEQ ID NO: 6568), mi1492 (SEQ ID NO: 6561), mi1493 (SEQ ID NO: 6560), mi1519 ((SEQ ID NO: 10971) or mi1520 (SEQ ID NO: 10972) may be used. These sequences fold similarly to mature guide stands of mi405 and mi1155 fold similarly to the mature guide strands of mir405 and mir1155. Therefore, the disclosure provides for nucleic acid molecules in which the mir-208 bind site sequence (SEQ ID NO: 5 or SEQ ID NO: 66) and/or the mir-122 binding site sequence (SEQ ID NO: 6 or SEQ ID NO: 67) may be inserted into the loop of any of the foregoing mature guide strands at locations similar to those set out in the sequences in Table 1.

miRNA of Interest

The nucleic acid molecules of the disclosure may comprise the sequence of the mature guide strand of any miRNA transcript sequence desired to have tissue-specific expression. For example, in one embodiment, skeletal expression of DUX4 miRNA is contemplated. Exemplary DUX4 miRNA sequences are provided in International Patent Application No. PCT/US2012/047999 (WO 2013/016352) and US patent publication no. US 201220225034 incorporated by reference herein in their entirety.

Two examples of miDUX4 are miDUX4-1 (miDux405; SEQ ID NO: 1): and miDUX4-2 (miDux1155; SEQ ID NO: 2). Exemplary nucleotide sequences comprising the DUX4 miRNA and the binding site for either miR-122 or miR-208 are provided in Table 1 and SEQ ID NOS: 10913-10968.

Any human miRNA may be expressed using the nucleic acid molecules of the disclosure , including those set out in the miRBase: the microRNA database websites (miRBase-.org), which are incorporated by reference herein in its entirety. Examples include but not limited to the following: miR-122, miR-124, miR-142, miR-155, miR-21, miR-17-92, miR-17, miR-18a, miR-19a, miR-20a, miR-19b-1, miR-26a, miR-126, miR-335, let-7 family: let-7a and let-7b, miR-34 (miR-34a), miR-10b, miR-208, miR-499, miR-195, miR-29a, miR-29b, and miR-29c. Additional exemplary miRNA are set out below in Table 2. Any of these miRNA may be used with different detargeting sequences, depending of the desired tissue specificity and desired detargeting.

TABLE 2

| miRNA ID | Accession | RPM | Chromosome | Start | End | Strand | Confidence |
|---|---|---|---|---|---|---|---|
| hsa-mir-99b | MI0000746 | 1742 | chr19 | 51692612 | 51692681 | + | ✓ |
| hsa-mir-99a | MI0000101 | 26393 | chr21 | 16539089 | 16539169 | + | ✓ |
| hsa-mir-9986 | MI0032316 | — | chr2 | 132433711 | 132433820 | + | — |
| hsa-mir-9985 | MI0032313 | 1873 | chrY | 4606120 | 4606228 | + | ✓ |
| hsa-mir-9983 | MI0033670 | 3 | chr6 | 39074314 | 39074381 | + | — |
| hsa-mir-9903 | MI0031831 | 1 | chr8 | 98393645 | 98393738 | − | ✓ |
| hsa-mir-9902-2 | MI0041071 | 406 | chr12 | 122709332 | 122709424 | − | — |
| hsa-mir-9902-1 | MI0031830 | 406 | chr12 | 122695907 | 122695999 | − | — |
| hsa-mir-9901 | MI0031829 | 13 | chr16 | 34163578 | 34163673 | + | — |
| hsa-mir-9900 | MI0031828 | — | chr3 | 112737089 | 112737181 | + | — |
| hsa-mir-9899 | MI0031827 | — | chr2 | 149330278 | 149330373 | − | — |
| hsa-mir-9898 | MI0031826 | 3 | chr12 | 52898889 | 52898984 | − | — |
| hsa-mir-9851 | MI0039502 | — | chr10 | 116827488 | 116827568 | − | — |
| hsa-mir-98 | MI0000100 | 45139 | chrX | 53556223 | 53556341 | − | ✓ |
| hsa-mir-9718 | MI0030983 | — | chr14 | 60648648 | 60648711 | + | — |
| hsa-mir-96 | MI0000098 | 483 | chr7 | 129774692 | 129774769 | − | ✓ |
| hsa-mir-9500 | MI0029185 | — | chr2 | 218823090 | 218823154 | + | — |
| hsa-mir-95 | MI0000097 | 164 | chr4 | 8005301 | 8005381 | − | — |
| hsa-mir-944 | MI0005769 | 80 | chr3 | 189829922 | 189830009 | + | — |
| hsa-mir-943 | MI0005768 | — | chr4 | 1986384 | 1986477 | − | — |
| sa-mir-942 | MI0005767 | 2 | chr1 | 117094643 | 117094728 | + | ✓ |
| hsa-mir-941-5 | MI0031520 | 57 | chr20 | 63919868 | 63919939 | + | ✓ |
| hsa-mir-941-4 | MI0005766 | 57 | chr20 | 63919756 | 63919827 | + | ✓ |
| hsa-mir-941-3 | MI0005765 | 57 | chr20 | 63919561 | 63919632 | + | ✓ |
| hsa-mir-941-2 | MI0005764 | 57 | chr20 | 63919505 | 63919576 | + | ✓ |
| hsa-mir-941-1 | MI0005763 | 57 | chr20 | 63919449 | 63919520 | + | ✓ |
| hsa-mir-940 | MI0005762 | — | chr16 | 2271747 | 2271840 | + | — |
| hsa-mir-939 | MI0005761 | — | chr8 | 144394149 | 144394230 | − | — |
| hsa-mir-938 | MI0005760 | 53 | chr10 | 29602264 | 29602346 | − | — |
| hsa-mir-937 | MI0005759 | 18 | chr8 | 143812957 | 143813042 | − | — |
| hsa-mir-936 | MI0005758 | — | chr10 | 104048089 | 104048186 | − | — |
| hsa-mir-935 | MI0005757 | 11 | chr19 | 53982307 | 53982397 | + | — |
| hsa-mir-934 | MI0005756 | 5 | chrX | 136550878 | 136550960 | + | — |
| hsa-mir-933 | MI0005755 | — | chr2 | 175167633 | 175167709 | − | — |
| hsa-mir-93 | MI0000095 | 2001 | chr7 | 100093768 | 100093847 | − | ✓ |
| hsa-mir-92b | MI0003560 | 4600 | chr1 | 155195177 | 155195272 | + | ✓ |
| hsa-mir-92a-2 | MI0000094 | 7185 | chrX | 134169538 | 134169612 | − | ✓ |
| hsa-mir-92a-1 | MI0000093 | 8600 | chr13 | 91351314 | 91351391 | + | ✓ |
| hsa-mir-924 | MI0005716 | 100 | chr18 | 39622123 | 39622175 | − | — |

TABLE 2-continued

| miRNA ID | Accession | RPM | Chromosome | Start | End | Strand | Confidence |
|----------|-----------|-----|------------|-------|-----|--------|------------|
| hsa-mir-922 | MI0005714 | 17 | chr3 | 197674496 | 197674576 | − | − |
| hsa-mir-921 | MI0005713 | − | chr1 | 166154743 | 166154798 | − | − |
| hsa-mir-920 | MI0005712 | − | chr12 | 24212421 | 24212495 | + | − |
| hsa-mir-9-3 | MI0000468 | 1073 | chr15 | 89368017 | 89368106 | + | ✓ |
| hsa-mir-9-2 | MI0000467 | 1073 | chr5 | 88666853 | 88666939 | − | ✓ |
| hsa-mir-9-1 | MI0000466 | 1073 | chr1 | 156420341 | 156420429 | − | ✓ |
| hsa-mir-892c | MI0022560 | 2 | chrX | 145992750 | 145992826 | − | − |
| hsa-mir-892b | MI0005538 | − | chrX | 145997198 | 145997274 | − | − |
| hsa-mir-892a | MI0005528 | − | chrX | 145996669 | 145996743 | − | − |
| hsa-mir-891b | MI0005534 | − | chrX | 146001053 | 146001131 | − | − |
| hsa-mir-891a | MI0005524 | − | chrX | 146027794 | 146027872 | − | − |
| hsa-mir-890 | MI0005533 | 2 | chrX | 145994275 | 145994351 | − | − |
| hsa-mir-889 | MI0005540 | 26 | chr14 | 101047901 | 101047979 | + | ✓ |
| hsa-mir-888 | MI0005537 | 784 | chrX | 145994784 | 145994860 | − | ✓ |
| hsa-mir-887 | MI0005562 | 6 | chr5 | 15935182 | 15935260 | + | ✓ |
| hsa-mir-885 | MI0005560 | 4 | chr3 | 10394489 | 10394562 | − | ✓ |
| hsa-mir-877 | MI0005561 | 70 | chr6 | 30584332 | 30584417 | + | − |
| hsa-mir-876 | MI0005542 | 28 | chr9 | 28863626 | 28863706 | − | ✓ |
| hsa-mir-875 | MI0005541 | − | chr8 | 99536786 | 99536861 | − | − |
| hsa-mir-874 | MI0005532 | 23 | chr5 | 137647572 | 137647649 | − | ✓ |
| hsa-mir-873 | MI0005564 | 8 | chr9 | 28888879 | 28888955 | − | ✓ |
| hsa-mir-8485 | MI0027288 | 1000 | chr2 | 50696172 | 50696262 | − | − |
| hsa-mir-8089 | MI0025925 | 28 | chr5 | 181043403 | 181043484 | − | − |
| hsa-mir-8088 | MI0025924 | − | chrX | 52336557 | 52336642 | − | − |
| hsa-mir-8087 | MI0025923 | 65 | chr11 | 27514970 | 27515047 | − | − |
| hsa-mir-8086 | MI0025922 | 209 | chr10 | 28289258 | 28289350 | − | − |
| hsa-mir-8085 | MI0025921 | − | chr19 | 44758657 | 44758721 | + | − |
| hsa-mir-8084 | MI0025920 | − | chr8 | 93029751 | 93029839 | + | − |
| hsa-mir-8083 | MI0025919 | − | chr1 | 153689705 | 153689793 | − | − |
| hsa-mir-8082 | MI0025918 | − | chr4 | 113152282 | 113152362 | + | − |
| hsa-mir-8081 | MI0025917 | 472 | chr9 | 106600928 | 106601022 | + | − |
| hsa-mir-8080 | MI0025916 | 15 | chr2 | 79866495 | 79866583 | − | − |
| hsa-mir-8079 | MI0025915 | − | chr13 | 44196129 | 44196200 | − | − |
| hsa-mir-8078 | MI0025914 | − | chr18 | 112256 | 112339 | − | − |
| hsa-mir-8077 | MI0025913 | − | chr19 | 42351131 | 42351205 | + | − |
| hsa-mir-8076 | MI0025912 | − | chr3 | 113432118 | 113432200 | − | − |
| hsa-mir-8075 | MI0025911 | − | chr13 | 113262920 | 113262999 | + | − |
| hsa-mir-8074 | MI0025910 | − | chr19 | 51206929 | 51207009 | − | − |
| hsa-mir-8073 | MI0025909 | − | chr13 | 110340958 | 110341029 | + | − |

TABLE 2-continued

| miRNA ID | Accession | RPM | Chromosome | Start | End | Strand | Confidence |
|---|---|---|---|---|---|---|---|
| hsa-mir-8072 | MI0025908 | 5 | chr12 | 123364764 | 123364843 | − | − |
| hsa-mir-8071-2 | MI0026417 | − | chr14 | 105640168 | 105640232 | + | − |
| hsa-mir-8071-1 | MI0025907 | − | chr14 | 105621116 | 105621180 | + | − |
| hsa-mir-8070 | MI0025906 | − | chr11 | 11783135 | 11783222 | − | − |
| hsa-mir-8069-2 | MI0031519 | 12 | chr21 | 13724189 | 13724274 | + | − |
| hsa-mir-8069-1 | MI0025905 | 12 | chr21 | 6859171 | 6859256 | + | − |
| hsa-mir-8068 | MI0025904 | − | chr11 | 28477481 | 28477548 | − | − |
| hsa-mir-8067 | MI0025903 | − | chr15 | 62304658 | 62304734 | − | − |
| hsa-mir-8066 | MI0025902 | − | chr4 | 101240795 | 101240872 | − | − |
| hsa-mir-8065 | MI0025901 | 180 | chr16 | 5632467 | 5632566 | + | − |
| hsa-mir-8064 | MI0025900 | 3 | chr3 | 52846463 | 52846552 | − | − |
| hsa-mir-8063 | MI0025899 | − | chr15 | 36972821 | 36972901 | − | − |
| hsa-mir-8062 | MI0025898 | − | chr20 | 7371608 | 7371692 | + | − |
| hsa-mir-8061 | MI0025897 | − | chr19 | 54645309 | 54645383 | + | − |
| hsa-mir-8060 | MI0025896 | − | chr3 | 96359964 | 96360039 | + | − |
| hsa-mir-8059 | MI0025895 | − | chr17 | 50768650 | 50768730 | + | − |
| hsa-mir-8058 | MI0025894 | 8 | chr16 | 82688931 | 82689019 | + | − |
| hsa-mir-8057 | MI0025893 | 5 | chr18 | 26591467 | 26591535 | − | − |
| hsa-mir-8056 | MI0025892 | − | chr5 | 173347455 | 173347536 | + | − |
| hsa-mir-8055 | MI0025891 | − | chr8 | 6622124 | 6622220 | − | − |
| hsa-mir-8054 | MI0025890 | − | chr11 | 23419105 | 23419190 | − | − |
| hsa-mir-8053 | MI0025889 | − | chr4 | 47652669 | 47652743 | + | − |
| hsa-mir-8052 | MI0025888 | − | chr11 | 130666735 | 130666803 | + | − |
| hsa-mir-802 | MI0003906 | 266 | chr21 | 35720715 | 35720808 | + | − |
| hsa-mir-7978 | MI0025754 | − | chr4 | 21464700 | 21464758 | − | − |
| hsa-mir-7977 | MI0025753 | 58 | chr3 | 176515103 | 176515151 | + | − |
| hsa-mir-7976 | MI0025752 | − | chr3 | 127587111 | 127587176 | − | ✓ |
| hsa-mir-7975 | MI0025751 | 121 | chr19 | 55123225 | 55123292 | − | − |
| hsa-mir-7974 | MI0025750 | 21 | chr19 | 11495544 | 11495622 | − | − |
| hsa-mir-7973-2 | MI0025749 | − | chr15 | 51314032 | 51314107 | − | − |
| hsa-mir-7973-1 | MI0025748 | − | chr15 | 51314034 | 51314109 | + | − |
| hsa-mir-7856 | MI0025526 | − | chr1 | 86357632 | 86357687 | − | − |
| hsa-mir-7855 | MI0025525 | 35 | chr14 | 64785626 | 64785686 | − | − |
| hsa-mir-7854 | MI0025524 | − | chr16 | 81533902 | 81533966 | + | − |
| hsa-mir-7853 | MI0025523 | 11 | chr6 | 6169304 | 6169435 | − | − |
| hsa-mir-7852 | MI0025522 | − | chr1 | 107897223 | 107897304 | + | − |
| hsa-mir-7851 | MI0025521 | 837 | chr12 | 42323700 | 42323859 | − | − |
| hsa-mir-7850 | MI0025520 | 64 | chr19 | 2630715 | 2630793 | + | − |
| hsa-mir-7849 | MI0025519 | − | chr4 | 146408583 | 146408688 | + | − |

TABLE 2-continued

| miRNA ID | Accession | RPM | Chromosome | Start | End | Strand | Confidence |
|---|---|---|---|---|---|---|---|
| hsa-mir-7848 | MI0025518 | — | chr8 | 133046481 | 133046581 | − | — |
| hsa-mir-7847 | MI0025517 | 24 | chr11 | 1880045 | 1880147 | + | — |
| hsa-mir-7846 | MI0025516 | 4 | chr1 | 12166943 | 12167038 | + | — |
| hsa-mir-7845 | MI0025515 | 4 | chr2 | 207166400 | 207166498 | + | — |
| hsa-mir-7844 | MI0025514 | — | chr12 | 94571231 | 94571352 | − | — |
| hsa-mir-7843 | MI0025510 | — | chr14 | 72516820 | 72516898 | + | — |
| hsa-mir-7706 | MI0025242 | 1 | chr15 | 85380596 | 85380662 | + | — |
| hsa-mir-7705 | MI0025241 | — | chr8 | 100702968 | 100703024 | − | — |
| hsa-mir-7704 | MI0025240 | 29 | chr2 | 176188843 | 176188901 | + | — |
| hsa-mir-7703 | MI0025239 | 4 | chr14 | 24143489 | 24143565 | − | — |
| hsa-mir-7702 | MI0025238 | — | chr9 | 111271156 | 111271214 | − | — |
| hsa-mir-770 | MI0005118 | — | chr14 | 100852390 | 100852487 | + | ✓ |
| hsa-mir-769 | MI0003834 | 120 | chr19 | 46018932 | 46019049 | + | ✓ |
| hsa-mir-767 | MI0003763 | 30 | chrX | 152393421 | 152393529 | − | ✓ |
| hsa-mir-766 | MI0003836 | 10 | chrX | 119646738 | 119646848 | − | ✓ |
| hsa-mir-765 | MI0005116 | 8 | chr1 | 156936131 | 156936244 | − | — |
| hsa-mir-764 | MI0003944 | — | chrX | 114639435 | 114639519 | + | — |
| hsa-mir-762 | MI0003892 | — | chr16 | 30893903 | 30893985 | + | — |
| hsa-mir-761 | MI0003941 | 40 | chr1 | 51836344 | 51836402 | − | — |
| hsa-mir-760 | MI0005567 | 9 | chr1 | 93846832 | 93846911 | + | — |
| hsa-mir-759 | MI0004065 | — | chr13 | 52810050 | 52810140 | + | — |
| hsa-mir-758 | MI0003757 | 2 | chr14 | 101026020 | 101026107 | + | ✓ |
| hsa-mir-7515 | MI0024354 | 20 | chr2 | 6650373 | 6650439 | + | — |
| hsa-mir-744 | MI0005559 | 324 | chr17 | 12081899 | 12081996 | + | ✓ |
| hsa-mir-718 | MI0012489 | 2 | chrX | 154019920 | 154019989 | − | — |
| hsa-mir-7162 | MI0023623 | — | chr10 | 30368597 | 30368665 | − | — |
| hsa-mir-7161 | MI0023619 | 107 | chr6 | 158609707 | 158609790 | + | — |
| hsa-mir-7160 | MI0023621 | — | chr8 | 2076589 | 2076640 | + | — |
| hsa-mir-7159 | MI0023620 | 50 | chr6 | 33899135 | 33899200 | + | — |
| hsa-mir-7158 | MI0023618 | — | chr2 | 5974662 | 5974732 | + | — |
| hsa-mir-7157 | MI0023617 | — | chr2 | 140586626 | 140586685 | − | — |
| hsa-mir-7156 | MI0023616 | — | chr1 | 77060143 | 77060202 | + | — |
| hsa-mir-7155 | MI0023615 | — | chr11 | 64341849 | 64341904 | − | — |
| hsa-mir-7154 | MI0023614 | — | chr11 | 45691704 | 45691776 | − | ✓ |
| hsa-mir-7153 | MI0023613 | — | chr18 | 11654885 | 11654941 | − | — |
| hsa-mir-7152 | MI0023612 | — | chr10 | 71790747 | 71790800 | + | — |
| hsa-mir-7151 | MI0023611 | — | chr10 | 67403351 | 67403410 | − | — |
| hsa-mir-7150 | MI0023610 | — | chr9 | 123485529 | 123485622 | − | — |
| hsa-mir-7114 | MI0022965 | — | chr9 | 137450026 | 137450086 | − | — |

TABLE 2-continued

| miRNA ID | Accession | RPM | Chromosome | Start | End | Strand | Confidence |
|---|---|---|---|---|---|---|---|
| hsa-mir-7113 | MI0022964 | — | chr11 | 68032864 | 68032922 | + | — |
| hsa-mir-7112 | MI0022963 | — | chr8 | 144262673 | 144262737 | − | — |
| hsa-mir-7111 | MI0022962 | — | chr6 | 35470508 | 35470579 | + | — |
| hsa-mir-7110 | MI0022961 | 578 | chr3 | 123161794 | 123161879 | + | — |
| hsa-mir-711 | MI0012488 | — | chr3 | 48578902 | 48578977 | − | — |
| hsa-mir-7109 | MI0022960 | 2 | chr22 | 31621467 | 31621531 | − | — |
| hsa-mir-7108 | MI0022959 | 100 | chr19 | 2434914 | 2435000 | − | — |
| hsa-mir-7107 | MI0022958 | 13 | chr12 | 121444273 | 121444352 | − | — |
| hsa-mir-7106 | MI0022957 | — | chr12 | 113159113 | 113159177 | − | — |
| hsa-mir-708 | MI0005543 | 184 | chr11 | 79402022 | 79402109 | − | ✓ |
| hsa-mir-7-3 | MI0000265 | 3279 | chr19 | 4770670 | 4770779 | + | — |
| hsa-mir-7-2 | MI0000264 | 3265 | chr15 | 88611825 | 88611934 | + | ✓ |
| hsa-mir-7-1 | MI0000263 | 3664 | chr9 | 83969748 | 83969857 | − | ✓ |
| hsa-mir-6895 | MI0022742 | 4 | chrX | 53195411 | 53195488 | − | — |
| hsa-mir-6894 | MI0022741 | 1 | chrX | 53198889 | 53198945 | − | — |
| hsa-mir-6893 | MI0022740 | — | chr8 | 144435551 | 144435619 | − | — |
| hsa-mir-6892 | MI0022739 | 35 | chr7 | 143382686 | 143382800 | + | — |
| hsa-mir-6891 | MI0022738 | 12 | chr6 | 31355224 | 31355316 | − | — |
| hsa-mir-6890 | MI0022737 | — | chr3 | 49099854 | 49099914 | − | — |
| hsa-mir-6889 | MI0022736 | — | chr22 | 41252992 | 41253050 | − | — |
| hsa-mir-6888 | MI0022735 | 2 | chr2 | 159186835 | 159186901 | + | — |
| hsa-mir-6887 | MI0022734 | — | chr19 | 35122700 | 35122764 | + | — |
| hsa-mir-6886 | MI0022733 | — | chr19 | 11113474 | 11113534 | + | — |
| hsa-mir-6885 | MI0022732 | — | chr19 | 6389638 | 6389703 | − | — |
| hsa-mir-6884 | MI0022731 | — | chr17 | 40026332 | 40026409 | − | — |
| hsa-mir-6883 | MI0022730 | — | chr17 | 8144994 | 8145071 | − | — |
| hsa-mir-6882 | MI0022729 | 29 | chr15 | 74840642 | 74840707 | − | — |
| hsa-mir-6881 | MI0022728 | — | chr15 | 74411357 | 74411432 | − | — |
| hsa-mir-6880 | MI0022727 | 2 | chr12 | 124337181 | 124337242 | − | — |
| hsa-mir-6879 | MI0022726 | 162 | chr11 | 65018505 | 65018570 | + | — |
| hsa-mir-6878 | MI0022725 | 69 | chr1 | 150492345 | 150492410 | + | — |
| hsa-mir-6877 | MI0022724 | — | chr9 | 133051996 | 133052059 | + | — |
| hsa-mir-6876 | MI0022723 | 12 | chr8 | 25345402 | 25345474 | + | — |
| hsa-mir-6875 | MI0022722 | 49 | chr7 | 100868036 | 100868107 | + | — |
| hsa-mir-6874 | MI0022721 | 18 | chr7 | 5711840 | 5711910 | − | — |
| hsa-mir-6873 | MI0022720 | 72 | chr6 | 33287227 | 33287289 | − | — |
| hsa-mir-6872 | MI0022719 | — | chr3 | 50273236 | 50273297 | + | — |
| hsa-mir-6871 | MI0022718 | — | chr20 | 41169023 | 41169078 | + | — |
| hsa-mir-6870 | MI0022717 | 2 | chr20 | 10649636 | 10649695 | − | — |

TABLE 2-continued

| miRNA ID | Accession | RPM | Chromosome | Start | End | Strand | Confidence |
|---|---|---|---|---|---|---|---|
| hsa-mir-6869 | MI0022716 | — | chr20 | 1392900 | 1392961 | − | — |
| hsa-mir-6868 | MI0022715 | — | chr17 | 76098019 | 76098076 | − | — |
| hsa-mir-6867 | MI0022714 | 4 | chr17 | 40193597 | 40193663 | + | — |
| hsa-mir-6866 | MI0022713 | — | chr17 | 40161933 | 40162001 | + | — |
| hsa-mir-6865 | MI0022712 | — | chr17 | 4970086 | 4970150 | − | — |
| hsa-mir-6864 | MI0022711 | — | chr17 | 4969702 | 4969771 | − | — |
| hsa-mir-6863 | MI0022710 | — | chr16 | 56904264 | 56904353 | + | — |
| hsa-mir-6862-2 | MI0026415 | — | chr16 | 28724252 | 28724321 | + | — |
| hsa-mir-6862-1 | MI0022709 | — | chr16 | 28390982 | 28391051 | − | — |
| hsa-mir-6861 | MI0022708 | 6 | chr12 | 112163258 | 112163321 | − | — |
| hsa-mir-6860 | MI0022707 | — | chr11 | 67045643 | 67045708 | + | — |
| hsa-mir-6859-4 | MI0031521 | — | chr16 | 17052 | 17119 | − | — |
| hsa-mir-6859-3 | MI0026421 | — | chr15 | 101973524 | 101973591 | + | — |
| hsa-mir-6859-2 | MI0026420 | — | chr1 | 187891 | 187958 | − | — |
| hsa-mir-6859-1 | MI0022705 | — | chr1 | 17369 | 17436 | − | — |
| hsa-mir-6858 | MI0022704 | 19 | chrX | 154450320 | 154450386 | + | — |
| hsa-mir-6857 | MI0022703 | — | chrX | 53405673 | 53405765 | − | — |
| hsa-mir-6856 | MI0022702 | 47 | chr9 | 130626297 | 130626363 | + | — |
| hsa-mir-6855 | MI0022701 | — | chr9 | 129869605 | 129869671 | + | ✓ |
| hsa-mir-6854 | MI0022700 | — | chr9 | 98229149 | 98229217 | − | — |
| hsa-mir-6853 | MI0022699 | — | chr9 | 35732922 | 35732995 | + | — |
| hsa-mir-6852 | MI0022698 | — | chr9 | 35710676 | 35710741 | − | — |
| hsa-mir-6851 | MI0022697 | 2 | chr9 | 33467869 | 33467935 | − | — |
| hsa-mir-6850 | MI0022696 | — | chr8 | 144791931 | 144791991 | − | — |
| hsa-mir-6849 | MI0022695 | — | chr8 | 144400277 | 144400345 | − | — |
| hsa-mir-6848 | MI0022694 | — | chr8 | 144317246 | 144317315 | − | — |
| hsa-mir-6847 | MI0022693 | — | chr8 | 144079874 | 144079942 | + | — |
| hsa-mir-6846 | MI0022692 | 20 | chr8 | 144057321 | 144057380 | − | — |
| hsa-mir-6845 | MI0022691 | — | chr8 | 143837756 | 143837816 | − | — |
| hsa-mir-6844 | MI0022690 | — | chr8 | 124508515 | 124508576 | − | — |
| hsa-mir-6843 | MI0022689 | — | chr8 | 27610601 | 27610751 | − | — |
| hsa-mir-6842 | MI0022688 | 34 | chr8 | 27433370 | 27433434 | + | — |
| hsa-mir-6841 | MI0022687 | — | chr8 | 24953796 | 24953867 | − | — |
| hsa-mir-6840 | MI0022686 | — | chr7 | 100356651 | 100356721 | + | — |
| hsa-mir-6839 | MI0022685 | — | chr7 | 64679064 | 64679176 | + | — |
| hsa-mir-6838 | MI0022684 | — | chr7 | 44073378 | 44073433 | − | — |
| hsa-mir-6837 | MI0022683 | — | chr7 | 44051766 | 44051829 | + | — |
| hsa-mir-6836 | MI0022682 | 10 | chr7 | 2257515 | 2257577 | − | — |
| hsa-mir-6835 | MI0022680 | — | chr6 | 34240673 | 34240736 | + | — |

TABLE 2-continued

| miRNA ID | Accession | RPM | Chromosome | Start | End | Strand | Confidence |
|---|---|---|---|---|---|---|---|
| hsa-mir-6834 | MI0022679 | — | chr6 | 33290245 | 33290325 | + | — |
| hsa-mir-6833 | MI0022678 | 1 | chr6 | 32179816 | 32179876 | + | — |
| hsa-mir-6832 | MI0022677 | 12 | chr6 | 31633787 | 31633858 | + | — |
| hsa-mir-6831 | MI0022676 | — | chr5 | 140563671 | 140563751 | − | — |
| hsa-mir-6830 | MI0022675 | — | chr5 | 132217849 | 132217918 | − | — |
| hsa-mir-6829 | MI0022674 | — | chr3 | 195882329 | 195882395 | − | — |
| hsa-mir-6828 | MI0022673 | — | chr3 | 170423103 | 170423162 | + | — |
| hsa-mir-6827 | MI0022672 | — | chr3 | 134367804 | 134367862 | − | — |
| hsa-mir-6826 | MI0022671 | 3 | chr3 | 129272146 | 129272243 | + | — |
| hsa-mir-6825 | MI0022670 | — | chr3 | 127575266 | 127575331 | − | — |
| hsa-mir-6824 | MI0022669 | — | chr3 | 48633636 | 48633698 | − | — |
| hsa-mir-6823 | MI0022668 | — | chr3 | 48549961 | 48550021 | − | — |
| hsa-mir-6822 | MI0022667 | 3 | chr3 | 39138206 | 39138266 | + | — |
| hsa-mir-6821 | MI0022666 | 5 | chr22 | 49962866 | 49962939 | + | — |
| hsa-mir-6820 | MI0022665 | — | chr22 | 37967563 | 37967624 | + | ✓ |
| hsa-mir-6819 | MI0022664 | — | chr22 | 36286847 | 36286907 | − | — |
| hsa-mir-6818 | MI0022663 | 5 | chr22 | 30007049 | 30007113 | + | — |
| hsa-mir-6817 | MI0022662 | — | chr22 | 25455646 | 25455711 | + | — |
| hsa-mir-6816 | MI0022661 | — | chr22 | 20114686 | 20114751 | − | — |
| hsa-mir-6815 | MI0022660 | — | chr21 | 45478266 | 45478326 | + | — |
| hsa-mir-6814 | MI0022659 | — | chr21 | 41746772 | 41746841 | − | — |
| hsa-mir-6813 | MI0022658 | — | chr20 | 64076955 | 64077010 | − | — |
| hsa-mir-6812 | MI0022657 | 90 | chr20 | 45425510 | 45425573 | + | — |
| hsa-mir-6811 | MI0022656 | — | chr2 | 237510931 | 237510988 | + | — |
| hsa-mir-6810 | MI0022655 | — | chr2 | 218341911 | 218341980 | + | — |
| hsa-mir-6809 | MI0022654 | 2 | chr2 | 217900513 | 217900628 | − | — |
| hsa-mir-6808 | MI0022653 | — | chr1 | 1339650 | 1339708 | − | — |
| hsa-mir-6807 | MI0022652 | 8 | chr19 | 58550285 | 58550376 | + | — |
| hsa-mir-6806 | MI0022651 | — | chr19 | 58334688 | 58334751 | + | — |
| hsa-mir-6805 | MI0022650 | 28 | chr19 | 55388181 | 55388242 | + | — |
| hsa-mir-6804 | MI0022649 | — | chr19 | 55230885 | 55230952 | − | — |
| hsa-mir-6803 | MI0022648 | 9 | chr19 | 55245186 | 55245250 | − | — |
| hsa-mir-6802 | MI0022647 | — | chr19 | 55239912 | 55239976 | − | — |
| hsa-mir-6801 | MI0022646 | — | chr19 | 52222020 | 52222098 | + | — |
| hsa-mir-6800 | MI0022645 | 1 | chr19 | 49832018 | 49832099 | + | — |
| hsa-mir-6799 | MI0022644 | — | chr19 | 49791866 | 49791934 | + | — |
| hsa-mir-6798 | MI0022643 | — | chr19 | 49009906 | 49009972 | + | — |
| hsa-mir-6797 | MI0022642 | 6 | chr19 | 41869627 | 41869698 | + | — |
| hsa-mir-6796 | MI0022641 | 2 | chr19 | 40369846 | 40369907 | + | — |

TABLE 2-continued

| miRNA ID | Accession | RPM | Chromosome | Start | End | Strand | Confidence |
|---|---|---|---|---|---|---|---|
| hsa-mir-6795 | MI0022640 | 3 | chr19 | 15179283 | 15179350 | – | – |
| hsa-mir-6794 | MI0022639 | 26 | chr19 | 12852260 | 12852327 | + | – |
| hsa-mir-6793 | MI0022638 | – | chr19 | 10828973 | 10829035 | + | – |
| hsa-mir-6792 | MI0022637 | 7 | chr19 | 7617439 | 7617505 | + | – |
| hsa-mir-6791 | MI0022636 | 5 | chr19 | 6736712 | 6736778 | – | – |
| hsa-mir-6790 | MI0022635 | – | chr19 | 6392921 | 6392983 | – | – |
| hsa-mir-6789 | MI0022634 | 51 | chr19 | 2235829 | 2235926 | – | – |
| hsa-mir-6788 | MI0022633 | 65 | chr18 | 10759584 | 10759649 | – | – |
| hsa-mir-6787 | MI0022632 | – | chr17 | 82236668 | 82236728 | + | – |
| hsa-mir-6786 | MI0022631 | 13 | chr17 | 81693757 | 81693869 | + | – |
| hsa-mir-6785 | MI0022630 | 2 | chr17 | 75498548 | 75498628 | + | – |
| hsa-mir-6784 | MI0022629 | – | chr17 | 45114367 | 45114433 | – | – |
| hsa-mir-6783 | MI0022628 | – | chr17 | 44934618 | 44934681 | – | – |
| hsa-mir-6782 | MI0022627 | – | chr17 | 44207771 | 44207839 | – | – |
| hsa-mir-6781 | MI0022626 | – | chr17 | 42823880 | 42823943 | – | – |
| hsa-mir-6780b | MI0022681 | – | chr6 | 43434542 | 43434620 | + | – |
| hsa-mir-6780a | MI0022625 | – | chr17 | 42708084 | 42708151 | – | – |
| hsa-mir-6779 | MI0022624 | 6 | chr17 | 38914979 | 38915042 | + | – |
| hsa-mir-6778 | MI0022623 | 5 | chr17 | 18340814 | 18340886 | – | – |
| hsa-mir-6777 | MI0022622 | – | chr17 | 17813480 | 17813545 | – | – |
| hsa-mir-6776 | MI0022621 | – | chr17 | 2692861 | 2692919 | – | – |
| hsa-mir-6775 | MI0022620 | – | chr16 | 87834592 | 87834660 | – | – |
| hsa-mir-6774 | MI0022619 | – | chr16 | 85918347 | 85918416 | + | – |
| hsa-mir-6773 | MI0022618 | – | chr16 | 68233426 | 68233499 | – | – |
| hsa-mir-6772 | MI0022617 | – | chr16 | 57772289 | 57772352 | – | – |
| hsa-mir-6771 | MI0022616 | 5 | chr16 | 50292616 | 50292675 | + | – |
| hsa-mir-6770-3 | MI0026419 | – | chr16 | 18379351 | 18379410 | – | ✓ |
| hsa-mir-6770-2 | MI0026418 | – | chr16 | 16329305 | 16329364 | + | ✓ |
| hsa-mir-6770-1 | MI0022615 | – | chr16 | 14930820 | 14930879 | + | ✓ |
| hsa-mir-6769b | MI0022706 | – | chr1 | 206474803 | 206474864 | + | – |
| hsa-mir-6769a | MI0022614 | – | chr16 | 4671318 | 4671390 | + | – |
| hsa-mir-6768 | MI0022613 | – | chr16 | 2463967 | 2464038 | + | – |
| hsa-mir-6767 | MI0022612 | – | chr16 | 2445392 | 2445457 | + | – |
| hsa-mir-6766 | MI0022611 | – | chr15 | 89326739 | 89326810 | – | – |
| hsa-mir-6765 | MI0022610 | 9 | chr14 | 105150778 | 105150864 | – | – |
| hsa-mir-6764 | MI0022609 | 2 | chr14 | 100277357 | 100277417 | + | – |
| hsa-mir-6763 | MI0022608 | 5 | chr12 | 132581997 | 132582061 | + | – |
| hsa-mir-6762 | MI0022607 | – | chr12 | 113291523 | 113291608 | + | – |
| hsa-mir-6761 | MI0022606 | 1 | chr12 | 111799834 | 111799905 | + | – |

TABLE 2-continued

| miRNA ID | Accession | RPM | Chromosome | Start | End | Strand | Confidence |
|---|---|---|---|---|---|---|---|
| hsa-mir-6760 | MI0022605 | — | chr12 | 111304142 | 111304209 | + | — |
| hsa-mir-676 | MI0016436 | — | chrX | 70022857 | 70022923 | + | ✓ |
| hsa-mir-6759 | MI0022604 | — | chr12 | 57748618 | 57748682 | − | — |
| hsa-mir-6758 | MI0022603 | — | chr12 | 57512688 | 57512750 | + | ✓ |
| hsa-mir-6757 | MI0022602 | 3 | chr12 | 53056944 | 53057012 | + | — |
| hsa-mir-6756 | MI0022601 | 21 | chr11 | 119312950 | 119313012 | − | — |
| hsa-mir-6755 | MI0022600 | — | chr11 | 86278333 | 86278398 | + | — |
| hsa-mir-6754 | MI0022599 | — | chr11 | 71473503 | 71473568 | + | — |
| hsa-mir-6753 | MI0022598 | 13 | chr11 | 68044794 | 68044957 | + | — |
| hsa-mir-6752 | MI0022597 | 17 | chr11 | 67490245 | 67490315 | + | — |
| hsa-mir-6751 | MI0022596 | 41 | chr11 | 65129916 | 65129978 | − | — |
| hsa-mir-6750 | MI0022595 | 2 | chr11 | 64898363 | 64898437 | − | — |
| hsa-mir-675 | MI0005416 | 20 | chr11 | 1996759 | 1996831 | − | ✓ |
| hsa-mir-6749 | MI0022594 | 7 | chr11 | 64902387 | 64902455 | − | — |
| hsa-mir-6748 | MI0022593 | — | chr11 | 62789815 | 62789885 | + | — |
| hsa-mir-6747 | MI0022592 | 5 | chr11 | 62567011 | 62567071 | − | — |
| hsa-mir-6746 | MI0022591 | 2 | chr11 | 61878216 | 61878278 | − | — |
| hsa-mir-6745 | MI0022590 | — | chr11 | 47179611 | 47179737 | − | — |
| hsa-mir-6744 | MI0022589 | — | chr11 | 1256605 | 1256670 | + | — |
| hsa-mir-6743 | MI0022588 | — | chr11 | 209336 | 209406 | + | — |
| hsa-mir-6742 | MI0022587 | — | chr1 | 228397048 | 228397109 | − | — |
| hsa-mir-6741 | MI0022586 | — | chr1 | 225922080 | 225922142 | − | — |
| hsa-mir-6740 | MI0022585 | 4 | chr1 | 202003124 | 202003236 | + | — |
| hsa-mir-6739 | MI0022584 | — | chr1 | 201863373 | 201863447 | + | — |
| hsa-mir-6738 | MI0022583 | — | chr1 | 155951273 | 155951336 | − | — |
| hsa-mir-6737 | MI0022582 | — | chr1 | 153962351 | 153962420 | − | — |
| hsa-mir-6736 | MI0022581 | 6 | chr1 | 145850587 | 145850645 | − | — |
| hsa-mir-6735 | MI0022580 | 1 | chr1 | 43448539 | 43448611 | + | — |
| hsa-mir-6734 | MI0022579 | 1 | chr1 | 43364648 | 43364715 | − | — |
| hsa-mir-6733 | MI0022578 | — | chr1 | 43171652 | 43171712 | − | — |
| hsa-mir-6732 | MI0022577 | 2 | chr1 | 37480230 | 37480289 | + | — |
| hsa-mir-6731 | MI0022576 | 2 | chr1 | 24919345 | 24919416 | − | — |
| hsa-mir-6730 | MI0022575 | 51 | chr1 | 12578957 | 12579023 | − | — |
| hsa-mir-6729 | MI0022574 | — | chr1 | 12029158 | 12029222 | + | — |
| hsa-mir-6728 | MI0022573 | 84 | chr1 | 8866502 | 8866590 | − | — |
| hsa-mir-6727 | MI0022572 | 5 | chr1 | 1312502 | 1312566 | − | — |
| hsa-mir-6726 | MI0022571 | — | chr1 | 1296110 | 1296170 | − | — |
| hsa-mir-6724-4 | MI0031518 | 1 | chr21 | 8432530 | 8432621 | + | — |
| hsa-mir-6724-3 | MI0031517 | 1 | chr21 | 8388362 | 8388453 | + | — |

TABLE 2-continued

| miRNA ID | Accession | RPM | Chromosome | Start | End | Strand | Confidence |
|---|---|---|---|---|---|---|---|
| hsa-mir-6724-2 | MI0031516 | 1 | chr21 | 8249505 | 8249596 | + | — |
| hsa-mir-6724-1 | MI0022559 | 1 | chr21 | 8205315 | 8205406 | + | — |
| hsa-mir-6722 | MI0022557 | — | chr9 | 136746893 | 136746970 | — | — |
| hsa-mir-6721 | MI0022556 | 2 | chr6 | 32170030 | 32170116 | — | — |
| hsa-mir-6720 | MI0022555 | 1 | chr6 | 1390314 | 1390411 | — | ✓ |
| hsa-mir-6719 | MI0022554 | 33 | chr19 | 39829716 | 39829802 | — | — |
| hsa-mir-6718 | MI0022553 | — | chr18 | 3885353 | 3885432 | + | — |
| hsa-mir-6717 | MI0022551 | — | chr14 | 21023314 | 21023386 | — | — |
| hsa-mir-6716 | MI0022550 | 13 | chr11 | 118644000 | 118644079 | + | — |
| hsa-mir-6715b | MI0022549 | — | chr10 | 112299612 | 112299688 | — | — |
| hsa-mir-6715a | MI0022548 | 24 | chr10 | 112299612 | 112299690 | + | — |
| hsa-mir-671 | MI0003760 | 77 | chr7 | 151238421 | 151238538 | + | ✓ |
| hsa-mir-670 | MI0003933 | — | chr11 | 43559656 | 43559753 | + | — |
| hsa-mir-668 | MI0003761 | 7 | chr14 | 101055258 | 101055323 | + | — |
| hsa-mir-665 | MI0005563 | 14 | chr14 | 100875033 | 100875104 | + | — |
| hsa-mir-664b | MI0019134 | 2 | chrX | 154768596 | 154768656 | + | ✓ |
| hsa-mir-664a | MI0006442 | 64 | chr1 | 220200538 | 220200619 | — | ✓ |
| hsa-mir-663b | MI0006336 | 9 | chr2 | 132256966 | 132257080 | — | — |
| hsa-mir-663a | MI0003672 | 10 | chr20 | 26208186 | 26208278 | — | — |
| hsa-mir-662 | MI0003670 | — | chr16 | 770183 | 770277 | + | — |
| hsa-mir-661 | MI0003669 | 130 | chr8 | 143945191 | 143945279 | — | — |
| hsa-mir-660 | MI0003684 | 510 | chrX | 50013241 | 50013337 | + | ✓ |
| hsa-mir-659 | MI0003683 | 1 | chr22 | 37847678 | 37847774 | — | — |
| hsa-mir-658 | MI0003682 | 1 | chr22 | 37844272 | 37844371 | — | — |
| hsa-mir-657 | MI0003681 | 7 | chr17 | 81125276 | 81125373 | — | — |
| hsa-mir-656 | MI0003678 | — | chr14 | 101066724 | 101066801 | + | — |
| hsa-mir-655 | MI0003677 | 6 | chr14 | 101049550 | 101049646 | + | — |
| hsa-mir-654 | MI0003676 | 5 | chr14 | 101040219 | 101040299 | + | ✓ |
| hsa-mir-653 | MI0003674 | — | chr7 | 93482760 | 93482855 | — | ✓ |
| hsa-mir-6529 | MI0039501 | — | chr3 | 120084564 | 120084648 | — | — |
| hsa-mir-652 | MI0003667 | 189 | chrX | 110055329 | 110055426 | + | ✓ |
| hsa-mir-6516 | MI0025513 | 2 | chr17 | 77089417 | 77089497 | + | — |
| hsa-mir-6515 | MI0022227 | 4 | chr19 | 12940484 | 12940540 | + | — |
| hsa-mir-6514 | MI0022226 | — | chr11 | 62792702 | 62792771 | — | — |
| hsa-mir-6513 | MI0022225 | 2 | chr2 | 218280125 | 218280188 | — | — |
| hsa-mir-6512 | MI0022224 | 2 | chr2 | 177313806 | 177313882 | — | — |
| hsa-mir-6511b-2 | MI0023431 | 6 | chr16 | 15134075 | 15134145 | — | — |
| hsa-mir-6511b-1 | MI0022552 | 5 | chr16 | 2106669 | 2106753 | — | — |
| hsa-mir-6511a-4 | MI0023566 | 3 | chr16 | 18344013 | 18344079 | — | ✓ |

TABLE 2-continued

| miRNA ID | Accession | RPM | Chromosome | Start | End | Strand | Confidence |
|---|---|---|---|---|---|---|---|
| hsa-mir-6511a-3 | MI0023565 | 3 | chr16 | 16368876 | 16368942 | + | ✓ |
| hsa-mir-6511a-2 | MI0023564 | 3 | chr16 | 16324588 | 16324654 | + | ✓ |
| hsa-mir-6511a-1 | MI0022223 | 3 | chr16 | 14925937 | 14926003 | + | ✓ |
| hsa-mir-6510 | MI0022222 | 5 | chr17 | 41517164 | 41517217 | − | — |
| hsa-mir-651 | MI0003666 | 7 | chrX | 8126965 | 8127061 | + | ✓ |
| hsa-mir-6509 | MI0022221 | — | chr7 | 135206994 | 135207078 | − | — |
| hsa-mir-6508 | MI0022220 | — | chr21 | 39447010 | 39447069 | + | — |
| hsa-mir-6507 | MI0022219 | 2 | chr10 | 98924499 | 98924568 | − | — |
| hsa-mir-6506 | MI0022218 | — | chr16 | 15611030 | 15611095 | − | — |
| hsa-mir-6505 | MI0022217 | 1 | chr12 | 48132797 | 48132867 | + | — |
| hsa-mir-6504 | MI0022216 | — | chr16 | 81611348 | 81611408 | + | — |
| hsa-mir-6503 | MI0022215 | — | chr11 | 60209071 | 60209156 | − | — |
| hsa-mir-6502 | MI0022214 | — | chr12 | 66251082 | 66251157 | + | — |
| hsa-mir-6501 | MI0022213 | — | chr21 | 33550662 | 33550728 | + | — |
| hsa-mir-6500 | MI0022211 | 58 | chr1 | 51060018 | 51060103 | + | — |
| hsa-mir-650 | MI0003665 | — | chr22 | 22822776 | 22822871 | + | — |
| hsa-mir-6499 | MI0022209 | 7 | chr5 | 151522087 | 151522148 | − | — |
| hsa-mir-649 | MI0003664 | — | chr22 | 21034176 | 21034272 | − | — |
| hsa-mir-648 | MI0003663 | 31 | chr22 | 17980868 | 17980961 | − | — |
| hsa-mir-647 | MI0003662 | 42 | chr20 | 63942631 | 63942726 | − | — |
| hsa-mir-646 | MI0003661 | — | chr20 | 60308474 | 60308567 | + | — |
| hsa-mir-645 | MI0003660 | 21 | chr20 | 50585786 | 50585879 | + | — |
| hsa-mir-644a | MI0003659 | — | chr20 | 34466325 | 34466418 | + | — |
| hsa-mir-643 | MI0003658 | 216 | chr19 | 52281797 | 52281893 | + | ✓ |
| hsa-mir-642b | MI0016685 | — | chr19 | 45674932 | 45675008 | − | ✓ |
| hsa-mir-642a | MI0003657 | — | chr19 | 45674928 | 45675024 | + | ✓ |
| hsa-mir-641 | MI0003656 | 4 | chr19 | 40282543 | 40282641 | − | — |
| hsa-mir-640 | MI0003655 | 36 | chr19 | 19435063 | 19435158 | + | — |
| hsa-mir-639 | MI0003654 | 78 | chr19 | 14529543 | 14529640 | + | — |
| hsa-mir-638 | MI0003653 | 9 | chr19 | 10718404 | 10718503 | + | — |
| hsa-mir-637 | MI0003652 | 37 | chr19 | 3961414 | 3961512 | − | — |
| hsa-mir-636 | MI0003651 | 37 | chr17 | 76736450 | 76736548 | − | — |
| hsa-mir-635 | MI0003650 | — | chr17 | 68424451 | 68424548 | − | — |
| hsa-mir-634 | MI0003649 | — | chr17 | 66787072 | 66787168 | + | — |
| hsa-mir-633 | MI0003648 | — | chr17 | 62944215 | 62944312 | + | — |
| hsa-mir-632 | MI0003647 | 10 | chr17 | 32350109 | 32350202 | + | — |
| hsa-mir-631 | MI0003645 | — | chr15 | 75353611 | 75353685 | − | — |
| hsa-mir-630 | MI0003644 | 3442 | chr15 | 72587217 | 72587313 | + | — |
| hsa-mir-629 | MI0003643 | 99 | chr15 | 70079372 | 70079468 | − | ✓ |

TABLE 2-continued

| miRNA ID | Accession | RPM | Chromosome | Start | End | Strand | Confidence |
|---|---|---|---|---|---|---|---|
| hsa-mir-628 | MI0003642 | 4 | chr15 | 55372940 | 55373034 | − | − |
| hsa-mir-627 | MI0003641 | 3 | chr15 | 42199570 | 42199666 | − | ✓ |
| hsa-mir-626 | MI0003640 | − | chr15 | 41691585 | 41691678 | + | − |
| hsa-mir-625 | MI0003639 | 24 | chr14 | 65471102 | 65471186 | + | ✓ |
| hsa-mir-624 | MI0003638 | − | chr14 | 31014646 | 31014742 | − | − |
| hsa-mir-623 | MI0003637 | − | chr13 | 99356131 | 99356228 | + | − |
| hsa-mir-622 | MI0003636 | 5 | chr13 | 90231182 | 90231277 | + | − |
| hsa-mir-621 | MI0003635 | 11 | chr13 | 40810766 | 40810861 | + | − |
| hsa-mir-620 | MI0003634 | 20 | chr12 | 116148560 | 116148654 | − | − |
| hsa-mir-619 | MI0003633 | 201 | chr12 | 108836908 | 108837006 | − | − |
| hsa-mir-618 | MI0003632 | 13 | chr12 | 80935736 | 80935833 | − | − |
| hsa-mir-617 | MI0003631 | 38 | chr12 | 80832533 | 80832629 | − | − |
| hsa-mir-6165 | MI0021472 | 39 | chr17 | 49510817 | 49510900 | + | − |
| hsa-mir-616 | MI0003629 | 1 | chr12 | 57519163 | 57519259 | − | ✓ |
| hsa-mir-615 | MI0003628 | 117 | chr12 | 54033950 | 54034045 | + | ✓ |
| hsa-mir-614 | MI0003627 | − | chr12 | 12915829 | 12915918 | + | − |
| hsa-mir-6134 | MI0021279 | 38 | chrX | 28495555 | 28495663 | − | − |
| hsa-mir-6133 | MI0021278 | 1 | chr7 | 133290881 | 133290988 | + | − |
| hsa-mir-6132 | MI0021277 | − | chr7 | 117020211 | 117020319 | + | − |
| hsa-mir-6131 | MI0021276 | − | chr5 | 10478037 | 10478145 | + | − |
| hsa-mir-6130 | MI0021275 | 335 | chr21 | 23079284 | 23079392 | + | − |
| hsa-mir-613 | MI0003626 | 24 | chr12 | 12764649 | 12764743 | + | − |
| hsa-mir-6129 | MI0021274 | 8 | chr17 | 49288346 | 49288454 | − | − |
| hsa-mir-6128 | MI0021272 | 20 | chr11 | 56743873 | 56743981 | + | − |
| hsa-mir-6127 | MI0021271 | 87 | chr1 | 22633258 | 22633366 | − | − |
| hsa-mir-6126 | MI0021260 | 68 | chr16 | 3485381 | 3485469 | − | − |
| hsa-mir-6125 | MI0021259 | 4 | chr12 | 62260359 | 62260454 | + | − |
| hsa-mir-6124 | MI0021258 | 214 | chr11 | 12163683 | 12163767 | + | − |
| hsa-mir-612 | MI0003625 | 45 | chr11 | 65444458 | 65444557 | + | − |
| hsa-mir-611 | MI0003624 | 4 | chr11 | 61792495 | 61792561 | − | − |
| hsa-mir-610 | MI0003623 | 13 | chr11 | 28056815 | 28056910 | + | − |
| hsa-mir-6090 | MI0020367 | − | chr11 | 128522390 | 128522449 | + | − |
| hsa-mir-609 | MI0003622 | − | chr10 | 104218789 | 104218883 | − | − |
| hsa-mir-6089-2 | MI0023563 | 2 | chrY | 2609191 | 2609254 | + | − |
| hsa-mir-6089-1 | MI0020366 | 2 | chrX | 2609191 | 2609254 | + | − |
| hsa-mir-6088 | MI0020365 | 24 | chr19 | 45436654 | 45436704 | + | − |
| hsa-mir-6086 | MI0020363 | 83 | chrX | 13590292 | 13590346 | + | − |
| hsa-mir-6085 | MI0020362 | − | chr15 | 62343029 | 62343138 | + | − |
| hsa-mir-6084 | MI0020361 | − | chr1 | 20633679 | 20633788 | + | − |

TABLE 2-continued

| miRNA ID | Accession | RPM | Chromosome | Start | End | Strand | Confidence |
|---|---|---|---|---|---|---|---|
| hsa-mir-6083 | MI0020360 | 6 | chr3 | 124374332 | 124374437 | + | — |
| hsa-mir-6082 | MI0020359 | 22 | chr4 | 171186184 | 171186292 | + | — |
| hsa-mir-6081 | MI0020358 | — | chr9 | 95065350 | 95065446 | + | — |
| hsa-mir-6080 | MI0020357 | — | chr17 | 64780759 | 64780824 | + | — |
| hsa-mir-608 | MI0003621 | — | chr10 | 100974985 | 100975084 | + | — |
| hsa-mir-6079 | MI0020356 | — | chr1 | 43838622 | 43838683 | + | — |
| hsa-mir-6078 | MI0020355 | — | chr10 | 3991160 | 3991259 | + | — |
| hsa-mir-6077 | MI0020354 | — | chr1 | 148388282 | 148388363 | + | — |
| hsa-mir-6076 | MI0020353 | 21 | chr14 | 49966399 | 49966511 | + | — |
| hsa-mir-6075 | MI0020352 | 24 | chr5 | 1510762 | 1510856 | − | — |
| hsa-mir-6074 | MI0020351 | 49 | chr12 | 66023620 | 66023726 | − | — |
| hsa-mir-6073 | MI0020350 | 4 | chr11 | 15969533 | 15969621 | − | — |
| hsa-mir-6072 | MI0020349 | — | chr10 | 2076019 | 2076089 | − | — |
| hsa-mir-6071 | MI0020348 | — | chr2 | 85783600 | 85783677 | − | — |
| hsa-mir-6070 | MI0020347 | — | chr21 | 43609887 | 43609989 | − | — |
| hsa-mir-607 | MI0003620 | — | chr10 | 96828669 | 96828764 | − | — |
| hsa-mir-6069 | MI0020346 | 244 | chr22 | 35336721 | 35336799 | − | — |
| hsa-mir-6068 | MI0020345 | — | chr1 | 63326925 | 63326984 | − | — |
| hsa-mir-606 | MI0003619 | — | chr10 | 75552458 | 75552553 | + | — |
| hsa-mir-605 | MI0003618 | 20 | chr10 | 51299573 | 51299655 | + | ✓ |
| hsa-mir-604 | MI0003617 | — | chr10 | 29545004 | 29545097 | − | — |
| hsa-mir-603 | MI0003616 | 1 | chr10 | 24275685 | 24275781 | + | — |
| hsa-mir-602 | MI0003615 | 4 | chr9 | 137838419 | 137838516 | + | — |
| hsa-mir-601 | MI0003614 | — | chr9 | 123402525 | 123402603 | − | — |
| hsa-mir-600 | MI0003613 | — | chr9 | 123111546 | 123111643 | − | — |
| hsa-mir-599 | MI0003611 | 3 | chr8 | 99536636 | 99536730 | − | — |
| hsa-mir-598 | MI0003610 | 138 | chr8 | 11035206 | 11035302 | − | ✓ |
| hsa-mir-597 | MI0003609 | — | chr8 | 9741672 | 9741768 | + | ✓ |
| hsa-mir-596 | MI0003608 | — | chr8 | 1817231 | 1817307 | + | — |
| hsa-mir-595 | MI0003607 | — | chr7 | 158532718 | 158532813 | − | — |
| hsa-mir-593 | MI0003605 | — | chr7 | 128081861 | 128081960 | + | — |
| hsa-mir-592 | MI0003604 | — | chr7 | 127058088 | 127058184 | − | — |
| hsa-mir-591 | MI0003603 | — | chr7 | 96219662 | 96219756 | − | — |
| hsa-mir-590 | MI0003602 | 270 | chr7 | 74191198 | 74191294 | + | ✓ |
| hsa-mir-589 | MI0003599 | 8 | chr7 | 5495819 | 5495917 | − | ✓ |
| hsa-mir-588 | MI0003597 | 4 | chr6 | 126484631 | 126484713 | + | — |
| hsa-mir-587 | MI0003595 | — | chr6 | 106784125 | 106784220 | + | — |
| hsa-mir-586 | MI0003594 | — | chr6 | 45197674 | 45197770 | − | — |
| hsa-mir-585 | MI0003592 | 5 | chr5 | 169263601 | 169263694 | − | ✓ |

TABLE 2-continued

| miRNA ID | Accession | RPM | Chromosome | Start | End | Strand | Confidence |
|---|---|---|---|---|---|---|---|
| hsa-mir-584 | MI0003591 | 97 | chr5 | 149062313 | 149062409 | − | ✓ |
| hsa-mir-583 | MI0003590 | — | chr5 | 96079138 | 96079212 | + | — |
| hsa-mir-582 | MI0003589 | 151 | chr5 | 59703606 | 59703703 | − | ✓ |
| hsa-mir-581 | MI0003588 | 3 | chr5 | 53951504 | 53951599 | − | — |
| hsa-mir-580 | MI0003587 | — | chr5 | 36147892 | 36147988 | − | — |
| hsa-mir-579 | MI0003586 | 4 | chr5 | 32394378 | 32394475 | − | ✓ |
| hsa-mir-5787 | MI0019797 | — | chr3 | 50227436 | 50227490 | + | — |
| hsa-mir-578 | MI0003585 | — | chr4 | 165386242 | 165386337 | + | — |
| hsa-mir-577 | MI0003584 | 13 | chr4 | 114656759 | 114656854 | + | ✓ |
| hsa-mir-576 | MI0003583 | 15 | chr4 | 109488698 | 109488795 | + | ✓ |
| hsa-mir-575 | MI0003582 | 81 | chr4 | 82753337 | 82753430 | − | — |
| hsa-mir-574 | MI0003581 | 780 | chr4 | 38868032 | 38868127 | + | ✓ |
| hsa-mir-5739 | MI0019412 | 50 | chr22 | 28459869 | 28459948 | + | — |
| hsa-mir-573 | MI0003580 | — | chr4 | 24520192 | 24520290 | − | — |
| hsa-mir-572 | MI0003579 | 6 | chr4 | 11368827 | 11368921 | + | — |
| hsa-mir-571 | MI0003578 | — | chr4 | 350157 | 350252 | + | — |
| hsa-mir-5708 | MI0019316 | 55 | chr8 | 80241389 | 80241473 | + | — |
| hsa-mir-5707 | MI0019315 | — | chr7 | 158591616 | 158591696 | + | — |
| hsa-mir-5706 | MI0019314 | — | chr5 | 119154637 | 119154716 | + | — |
| hsa-mir-5705 | MI0019313 | — | chr4 | 87300495 | 87300583 | − | — |
| hsa-mir-5704 | MI0019312 | — | chr3 | 131985855 | 131985931 | − | — |
| hsa-mir-5703 | MI0019310 | 6 | chr2 | 227472132 | 227472187 | + | — |
| hsa-mir-5702 | MI0019309 | — | chr2 | 226658710 | 226658793 | − | — |
| hsa-mir-5701-3 | MI0031522 | — | chr15 | 21951242 | 21951323 | + | — |
| hsa-mir-5701-2 | MI0019593 | — | chr15 | 21513959 | 21514040 | + | — |
| hsa-mir-5701-1 | MI0019308 | — | chr15 | 20940252 | 20940333 | + | — |
| hsa-mir-5700 | MI0019307 | — | chr12 | 94561789 | 94561859 | + | — |
| hsa-mir-570 | MI0003577 | 4 | chr3 | 195699401 | 195699497 | + | — |
| hsa-mir-5699 | MI0019306 | 6 | chr10 | 641689 | 641778 | − | — |
| hsa-mir-5698 | MI0019305 | — | chr1 | 154104521 | 154104592 | − | — |
| hsa-mir-5697 | MI0019304 | — | chr1 | 9967381 | 9967458 | + | — |
| hsa-mir-5696 | MI0019303 | — | chr2 | 101309450 | 101309534 | + | — |
| hsa-mir-5695 | MI0019302 | 1 | chr19 | 12920320 | 12920404 | + | — |
| hsa-mir-5694 | MI0019301 | 2 | chr14 | 67441855 | 67441930 | − | — |
| hsa-mir-5693 | MI0019300 | 4 | chr13 | 51348567 | 51348639 | − | — |
| hsa-mir-5692c-2 | MI0019289 | 3 | chr7 | 97964405 | 97964481 | − | — |
| hsa-mir-5692c-1 | MI0019288 | — | chr5 | 135802985 | 135803075 | − | — |
| hsa-mir-5692b | MI0019311 | — | chr21 | 42950928 | 42951014 | − | — |
| hsa-mir-5692a-2 | MI0019298 | — | chr8 | 12719132 | 12719190 | + | — |

TABLE 2-continued

| miRNA ID | Accession | RPM | Chromosome | Start | End | Strand | Confidence |
|---|---|---|---|---|---|---|---|
| hsa-mir-5692a-1 | MI0019297 | — | chr7 | 97963658 | 97963726 | + | — |
| hsa-mir-5691 | MI0019296 | — | chr11 | 9090312 | 9090379 | − | — |
| hsa-mir-5690 | MI0019295 | — | chr6 | 35664717 | 35664789 | − | — |
| hsa-mir-569 | MI0003576 | — | chr3 | 171106664 | 171106759 | − | — |
| hsa-mir-5689 | MI0019294 | 9 | chr6 | 10439717 | 10439794 | + | — |
| hsa-mir-5688 | MI0019292 | — | chr3 | 85385710 | 85385792 | + | — |
| hsa-mir-5687 | MI0019291 | — | chr5 | 55508850 | 55508926 | − | — |
| hsa-mir-5685 | MI0019287 | 21 | chr6 | 53276993 | 53277071 | + | — |
| hsa-mir-5684 | MI0019285 | 46 | chr19 | 12787128 | 12787192 | + | — |
| hsa-mir-5683 | MI0019284 | — | chr6 | 6169334 | 6169409 | + | — |
| hsa-mir-5682 | MI0019282 | — | chr3 | 121049640 | 121049715 | + | ✓ |
| hsa-mir-5681b | MI0019293 | — | chr8 | 74548550 | 74548609 | − | — |
| hsa-mir-5681a | MI0019281 | — | chr8 | 74548543 | 74548617 | + | — |
| hsa-mir-5680 | MI0019280 | — | chr8 | 102125432 | 102125515 | + | — |
| hsa-mir-568 | MI0003574 | — | chr3 | 114316475 | 114316569 | − | — |
| hsa-mir-567 | MI0003573 | 70 | chr3 | 112112801 | 112112898 | + | — |
| hsa-mir-564 | MI0003570 | — | chr3 | 44861888 | 44861981 | + | — |
| hsa-mir-563 | MI0003569 | — | chr3 | 15873771 | 15873849 | + | — |
| hsa-mir-562 | MI0003568 | — | chr2 | 232172653 | 232172747 | + | — |
| hsa-mir-561 | MI0003567 | 32 | chr2 | 188297492 | 188297588 | + | ✓ |
| hsa-mir-5591 | MI0019151 | — | chr4 | 39411910 | 39411974 | + | — |
| hsa-mir-5590 | MI0019150 | — | chr2 | 134857820 | 134857873 | + | — |
| hsa-mir-559 | MI0003565 | 9 | chr2 | 47377675 | 47377770 | + | — |
| hsa-mir-5589 | MI0019148 | — | chr19 | 10038354 | 10038413 | + | — |
| hsa-mir-5588 | MI0019147 | 97 | chr3 | 185253210 | 185253272 | − | — |
| hsa-mir-5587 | MI0019144 | 3 | chr16 | 535316 | 535368 | + | — |
| hsa-mir-5586 | MI0019143 | — | chr14 | 59646962 | 59647020 | − | — |
| hsa-mir-5585 | MI0019142 | 320 | chr1 | 32086949 | 32087007 | + | — |
| hsa-mir-5584 | MI0019141 | — | chr1 | 44545493 | 44545552 | + | — |
| hsa-mir-5583-2 | MI0019140 | — | chr18 | 39676719 | 39676777 | − | ✓ |
| hsa-mir-5583-1 | MI0019139 | — | chr18 | 39676721 | 39676779 | + | ✓ |
| hsa-mir-5582 | MI0019138 | — | chr11 | 46753125 | 46753192 | − | — |
| hsa-mir-5581 | MI0019136 | — | chr1 | 37500935 | 37500994 | − | — |
| hsa-mir-5580 | MI0019135 | — | chr14 | 53948427 | 53948484 | − | — |
| hsa-mir-558 | MI0003564 | 134 | chr2 | 32532153 | 32532246 | + | — |
| hsa-mir-5579 | MI0019133 | — | chr11 | 79422169 | 79422226 | − | — |
| hsa-mir-5572 | MI0019117 | 94 | chr15 | 80581103 | 80581239 | + | — |
| hsa-mir-5571 | MI0019115 | 22 | chr22 | 22886267 | 22886379 | + | — |
| hsa-mir-557 | MI0003563 | — | chr1 | 168375524 | 168375621 | + | — |

TABLE 2-continued

| miRNA ID | Accession | RPM | Chromosome | Start | End | Strand | Confidence |
|----------|-----------|-----|------------|-------|-----|--------|------------|
| hsa-mir-556 | MI0003562 | 3 | chr1 | 162342546 | 162342640 | + | ✓ |
| hsa-mir-555 | MI0003561 | — | chr1 | 155346350 | 155346445 | − | — |
| hsa-mir-554 | MI0003559 | — | chr1 | 151545796 | 151545891 | + | — |
| hsa-mir-553 | MI0003558 | — | chr1 | 100281241 | 100281308 | + | — |
| hsa-mir-552 | MI0003557 | — | chr1 | 34669599 | 34669694 | − | ✓ |
| hsa-mir-551b | MI0003575 | 70 | chr3 | 168551854 | 168551949 | + | ✓ |
| hsa-mir-551a | MI0003556 | 7 | chr1 | 3560695 | 3560790 | − | — |
| hsa-mir-550b-2 | MI0016687 | 2 | chr7 | 32732981 | 32733077 | − | — |
| hsa-mir-550b-1 | MI0016686 | 2 | chr7 | 30289794 | 30289890 | − | — |
| hsa-mir-550a-3 | MI0003762 | 16 | chr7 | 29680734 | 29680828 | − | ✓ |
| hsa-mir-550a-2 | MI0003601 | 16 | chr7 | 32732981 | 32733077 | + | ✓ |
| hsa-mir-550a-1 | MI0003600 | 16 | chr7 | 30289794 | 30289890 | + | ✓ |
| hsa-mir-549a | MI0003679 | — | chr15 | 80841978 | 80842073 | − | — |
| hsa-mir-548z | MI0016688 | 3 | chr12 | 64622509 | 64622605 | − | — |
| hsa-mir-548y | MI0016595 | 1 | chr14 | 47760995 | 47761104 | − | ✓ |
| hsa-mir-548x-2 | MI0016833 | 8 | chr13 | 65966330 | 65966429 | − | — |
| hsa-mir-548x | MI0014244 | 3 | chr21 | 18686090 | 18686164 | − | ✓ |
| hsa-mir-548w | MI0014222 | 3 | chr16 | 26025237 | 26025310 | + | — |
| hsa-mir-548v | MI0014174 | 9 | chr8 | 17681578 | 17681657 | − | ✓ |
| hsa-mir-548u | MI0014168 | 17 | chr6 | 57390132 | 57390212 | + | — |
| hsa-mir-548t | MI0014164 | 2 | chr4 | 173268160 | 173268233 | + | — |
| hsa-mir-548s | MI0014141 | 5 | chr2 | 11767444 | 11767525 | + | — |
| hsa-mir-548q | MI0010637 | 5 | chr10 | 12725254 | 12725353 | − | — |
| hsa-mir-548p | MI0006420 | 7 | chr5 | 100816482 | 100816565 | − | — |
| hsa-mir-548o-2 | MI0016746 | 15 | chr20 | 38516563 | 38516632 | + | ✓ |
| hsa-mir-548o | MI0006402 | 5 | chr7 | 102405742 | 102405855 | − | — |
| hsa-mir-548n | MI0006399 | 7 | chr7 | 34940760 | 34940834 | − | — |
| hsa-mir-548m | MI0006400 | — | chrX | 95063141 | 95063226 | − | — |
| hsa-mir-548l | MI0006361 | 8 | chr11 | 94466495 | 94466580 | − | — |
| hsa-mir-548k | MI0006354 | 15 | chr11 | 70283955 | 70284070 | + | ✓ |
| hsa-mir-548j | MI0006345 | 1 | chr22 | 26555212 | 26555323 | − | ✓ |
| hsa-mir-548l-4 | MI0006424 | 16 | chrX | 84225752 | 84225828 | − | — |
| hsa-mir-548l-3 | MI0006423 | 17 | chr8 | 8088941 | 8089089 | − | — |
| hsa-mir-548l-2 | MI0006422 | 17 | chr4 | 9556168 | 9556316 | − | — |
| hsa-mir-548l-1 | MI0006421 | 17 | chr3 | 125790404 | 125790552 | − | — |
| hsa-mir-548h-5 | MI0016751 | 2 | chr6 | 131792172 | 131792231 | + | — |
| hsa-mir-548h-4 | MI0006414 | 4 | chr8 | 27048853 | 27048963 | − | ✓ |
| hsa-mir-548h-3 | MI0006413 | 6 | chr17 | 13543529 | 13543646 | − | ✓ |
| hsa-mir-548h-2 | MI0006412 | 3 | chr16 | 11306440 | 11306527 | − | ✓ |

TABLE 2-continued

| miRNA ID | Accession | RPM | Chromosome | Start | End | Strand | Confidence |
|---|---|---|---|---|---|---|---|
| hsa-mir-548h-1 | MI0006411 | 2 | chr14 | 64095024 | 64095125 | − | − |
| hsa-mir-548g | MI0006395 | — | chr4 | 147344629 | 147344717 | − | − |
| hsa-mir-548f-5 | MI0006378 | — | chrX | 32641474 | 32641559 | − | − |
| hsa-mir-548f-4 | MI0006377 | 8 | chr7 | 147378017 | 147378121 | − | − |
| hsa-mir-548f-3 | MI0006376 | 3 | chr5 | 110513829 | 110513915 | − | − |
| hsa-mir-548f-2 | MI0006375 | 2 | chr2 | 212426263 | 212426360 | − | − |
| hsa-mir-548f-1 | MI0006374 | 3 | chr10 | 54607874 | 54607957 | − | − |
| hsa-mir-548e | MI0006344 | 14 | chr10 | 110988926 | 110989013 | + | ✓ |
| hsa-mir-548d-2 | MI0003671 | 15 | chr17 | 67471489 | 67471585 | − | ✓ |
| hsa-mir-548d-1 | MI0003668 | 12 | chr8 | 123348034 | 123348130 | − | ✓ |
| hsa-mir-548c | MI0003630 | 13 | chr12 | 64622509 | 64622605 | + | − |
| hsa-mir-548bc | MI0032315 | 1 | chr17 | 39297400 | 39297509 | + | − |
| hsa-mir-548bb | MI0029321 | — | chr3 | 60617805 | 60617870 | − | − |
| hsa-mir-548ba | MI0025747 | 8 | chr2 | 49059603 | 49059658 | + | − |
| hsa-mir-548b | MI0003596 | 35 | chr6 | 119069047 | 119069143 | − | ✓ |
| hsa-mir-548az | MI0022212 | 8 | chr8 | 119325171 | 119325265 | + | − |
| hsa-mir-548ay | MI0022210 | 8 | chr3 | 32506283 | 32506389 | − | ✓ |
| hsa-mir-548ax | MI0019286 | 1 | chrX | 11318614 | 11318686 | − | − |
| hsa-mir-548aw | MI0019283 | — | chr9 | 132945707 | 132945771 | + | − |
| hsa-mir-548av | MI0019152 | 25 | chr18 | 72853321 | 72853382 | − | − |
| hsa-mir-548au | MI0019145 | 8 | chr9 | 93594841 | 93594894 | + | − |
| hsa-mir-548at | MI0019137 | — | chr17 | 42494773 | 42494830 | + | ✓ |
| hsa-mir-548as | MI0019132 | 1 | chr13 | 92490163 | 92490220 | + | − |
| hsa-mir-548ar | MI0019131 | — | chr13 | 114244505 | 114244561 | + | ✓ |
| hsa-mir-548aq | MI0019130 | 3 | chr3 | 185767847 | 185767904 | − | ✓ |
| hsa-mir-548ap | MI0017875 | 2 | chr15 | 85825635 | 85825730 | + | ✓ |
| hsa-mir-548ao | MI0017871 | — | chr8 | 41271048 | 41271143 | − | − |
| hsa-mir-548an | MI0016907 | — | chrX | 106639814 | 106639896 | + | ✓ |
| hsa-mir-548am | MI0016904 | 16 | chrX | 16627012 | 16627085 | − | ✓ |
| hsa-mir-548al | MI0016851 | 1 | chr11 | 74399237 | 74399333 | + | − |
| hsa-mir-548ak | MI0016840 | 3 | chr10 | 12130760 | 12130816 | − | − |
| hsa-mir-548aj-2 | MI0016815 | 2 | chrX | 38023895 | 38023986 | − | − |
| hsa-mir-548aj-1 | MI0016814 | 2 | chr6 | 132115192 | 132115263 | − | − |
| hsa-mir-548ai | MI0016813 | — | chr6 | 99124609 | 99124696 | + | − |
| hsa-mir-548ah | MI0016796 | 7 | chr4 | 76575551 | 76575626 | + | − |
| hsa-mir-548ag-2 | MI0016794 | 4 | chr20 | 60564562 | 60564625 | + | ✓ |
| hsa-mir-548ag-1 | MI0016793 | 3 | chr4 | 60922619 | 60922684 | + | − |
| hsa-mir-548ae-2 | MI0016780 | 10 | chr5 | 58530043 | 58530109 | − | ✓ |
| hsa-mir-548ae-1 | MI0016779 | 15 | chr2 | 184378975 | 184379044 | + | − |

TABLE 2-continued

| miRNA ID | Accession | RPM | Chromosome | Start | End | Strand | Confidence |
|----------|-----------|-----|------------|-------|-----|--------|------------|
| hsa-mir-548ad | MI0016770 | 8 | chr2 | 35471405 | 35471486 | + | — |
| hsa-mir-548ac | MI0016762 | 6 | chr1 | 116560024 | 116560111 | − | — |
| hsa-mir-548ab | MI0016752 | 7 | chr3 | 103524033 | 103524116 | − | — |
| hsa-mir-548aa-2 | MI0016690 | 1 | chr17 | 67471489 | 67471585 | + | — |
| hsa-mir-548aa-1 | MI0016689 | 1 | chr8 | 123348034 | 123348130 | + | — |
| hsa-mir-548a-3 | MI0003612 | 18 | chr8 | 104484369 | 104484465 | − | ✓ |
| hsa-mir-548a-2 | MI0003598 | 25 | chr6 | 135239160 | 135239256 | + | — |
| hsa-mir-548a-1 | MI0003593 | 21 | chr6 | 18571784 | 18571880 | + | — |
| hsa-mir-545 | MI0003516 | 11 | chrX | 74287104 | 74287209 | − | ✓ |
| hsa-mir-544b | MI0014159 | 1 | chr3 | 124732439 | 124732516 | + | — |
| hsa-mir-544a | MI0003515 | 2 | chr14 | 101048658 | 101048748 | + | — |
| hsa-mir-543 | MI0005565 | 6 | chr14 | 101031987 | 101032064 | + | — |
| hsa-mir-542 | MI0003686 | 174 | chrX | 134541341 | 134541437 | − | ✓ |
| hsa-mir-541 | MI0005539 | 28 | chr14 | 101064495 | 101064578 | + | ✓ |
| hsa-mir-539 | MI0003514 | 4 | chr14 | 101047321 | 101047398 | + | ✓ |
| hsa-mir-532 | MI0003205 | 322 | chrX | 50003148 | 50003238 | + | ✓ |
| hsa-mir-527 | MI0003179 | 27 | chr19 | 53754018 | 53754102 | + | — |
| hsa-mir-526b | MI0003150 | 1 | chr19 | 53694393 | 53694475 | + | — |
| hsa-mir-526a-2 | MI0003168 | — | chr19 | 53726922 | 53726986 | + | — |
| hsa-mir-526a-1 | MI0003157 | 23 | chr19 | 53706252 | 53706336 | + | — |
| hsa-mir-525 | MI0003152 | 8 | chr19 | 53697533 | 53697617 | + | — |
| hsa-mir-524 | MI0003160 | 2 | chr19 | 53711002 | 53711088 | + | — |
| hsa-mir-523 | MI0003153 | 3 | chr19 | 53698385 | 53698471 | + | — |
| hsa-mir-522 | MI0003177 | 8 | chr19 | 53751211 | 53751297 | + | ✓ |
| hsa-mir-521-2 | MI0003163 | 13 | chr19 | 53716594 | 53716680 | + | — |
| hsa-mir-521-1 | MI0003176 | — | chr19 | 53748636 | 53748722 | + | — |
| hsa-mir-520h | MI0003175 | 18 | chr19 | 53742512 | 53742599 | + | — |
| hsa-mir-520g | MI0003166 | 17 | chr19 | 53722166 | 53722255 | + | — |
| hsa-mir-520f | MI0003146 | 4 | chr19 | 53682159 | 53682245 | + | — |
| hsa-mir-520e | MI0003143 | 33 | chr19 | 53675711 | 53675797 | + | — |
| hsa-mir-520d | MI0003164 | — | chr19 | 53720096 | 53720182 | + | — |
| hsa-mir-520c | MI0003158 | 6 | chr19 | 53707453 | 53707539 | + | ✓ |
| hsa-mir-520b | MI0003155 | 9 | chr19 | 53701227 | 53701287 | + | — |
| hsa-mir-520a | MI0003149 | 4 | chr19 | 53690881 | 53690965 | + | ✓ |
| hsa-mir-519e | MI0003145 | 10 | chr19 | 53679940 | 53680023 | + | — |
| hsa-mir-519d | MI0003162 | 3 | chr19 | 53713347 | 53713434 | + | — |
| hsa-mir-519c | MI0003148 | 14 | chr19 | 53686469 | 53686555 | + | — |
| hsa-mir-519b | MI0003151 | 8 | chr19 | 53695213 | 53695293 | + | ✓ |
| hsa-mir-519a-2 | MI0003182 | 8 | chr19 | 53762344 | 53762430 | + | ✓ |

TABLE 2-continued

| miRNA ID | Accession | RPM | Chromosome | Start | End | Strand | Confidence |
|---|---|---|---|---|---|---|---|
| hsa-mir-519a-1 | MI0003178 | 11 | chr19 | 53752397 | 53752481 | + | ✓ |
| hsa-mir-5197 | MI0018176 | — | chr5 | 143679860 | 143679971 | + | — |
| hsa-mir-5196 | MI0018175 | 20 | chr19 | 35345513 | 35345627 | + | — |
| hsa-mir-5195 | MI0018174 | — | chr14 | 106850885 | 106850999 | − | — |
| hsa-mir-5194 | MI0018173 | — | chr8 | 130008334 | 130008453 | − | — |
| hsa-mir-5193 | MI0018172 | 2 | chr3 | 49806137 | 49806245 | − | — |
| hsa-mir-5192 | MI0018171 | 4 | chr2 | 62205826 | 62205917 | + | — |
| hsa-mir-5191 | MI0018170 | 64 | chr1 | 201719508 | 201719627 | + | — |
| hsa-mir-5190 | MI0018169 | — | chr18 | 13459947 | 13460026 | + | — |
| hsa-mir-518f | MI0003154 | 6 | chr19 | 53700015 | 53700101 | + | — |
| hsa-mir-518e | MI0003169 | 3 | chr19 | 53729838 | 53729925 | + | — |
| hsa-mir-518d | MI0003171 | — | chr19 | 53734877 | 53734963 | + | — |
| hsa-mir-518c | MI0003159 | 5 | chr19 | 53708735 | 53708835 | + | — |
| hsa-mir-518b | MI0003156 | 6 | chr19 | 53702737 | 53702819 | + | — |
| hsa-mir-518a-2 | MI0003173 | — | chr19 | 53739333 | 53739419 | + | — |
| hsa-mir-518a-1 | MI0003170 | — | chr19 | 53731006 | 53731090 | + | — |
| hsa-mir-5189 | MI0018168 | — | chr16 | 88468918 | 88469031 | + | — |
| hsa-mir-5188 | MI0018167 | — | chr12 | 124915547 | 124915659 | + | — |
| hsa-mir-5187 | MI0018166 | 1 | chr1 | 161227186 | 161227261 | + | — |
| hsa-mir-5186 | MI0018165 | 13 | chr3 | 151565876 | 151565995 | − | — |
| hsa-mir-517c | MI0003174 | 1 | chr19 | 53741313 | 53741407 | + | — |
| hsa-mir-517b | MI0003165 | 1 | chr19 | 53721076 | 53721142 | + | — |
| hsa-mir-517a | MI0003161 | 1 | chr19 | 53712268 | 53712354 | + | — |
| hsa-mir-516b-2 | MI0003167 | — | chr19 | 53725442 | 53725526 | + | — |
| hsa-mir-516b-1 | MI0003172 | — | chr19 | 53736845 | 53736934 | + | — |
| hsa-mir-516a-2 | MI0003181 | 32 | chr19 | 53761133 | 53761222 | + | — |
| hsa-mir-516a-1 | MI0003180 | 31 | chr19 | 53756741 | 53756830 | + | — |
| hsa-mir-515-2 | MI0003147 | 7 | chr19 | 53685009 | 53685091 | + | — |
| hsa-mir-515-1 | MI0003144 | 7 | chr19 | 53679003 | 53679085 | + | — |
| hsa-mir-514b | MI0014251 | 573 | chrX | 147250151 | 147250230 | − | ✓ |
| hsa-mir-514a-3 | MI0003200 | 434 | chrX | 147284641 | 147284728 | − | ✓ |
| hsa-mir-514a-2 | MI0003199 | 434 | chrX | 147281943 | 147282030 | − | ✓ |
| hsa-mir-514a-1 | MI0003198 | 431 | chrX | 147279247 | 147279344 | − | ✓ |
| hsa-mir-513c | MI0006649 | 23 | chrX | 147189704 | 147189787 | − | ✓ |
| hsa-mir-513b | MI0006648 | 24 | chrX | 147199044 | 147199127 | − | — |
| hsa-mir-513a-2 | MI0003192 | 20 | chrX | 147225826 | 147225952 | − | ✓ |
| hsa-mir-513a-1 | MI0003191 | 23 | chrX | 147213463 | 147213591 | − | ✓ |
| hsa-mir-512-2 | MI0003141 | — | chr19 | 53669157 | 53669254 | + | ✓ |
| hsa-mir-512-1 | MI0003140 | — | chr19 | 53666679 | 53666762 | + | ✓ |

TABLE 2-continued

| miRNA ID | Accession | RPM | Chromosome | Start | End | Strand | Confidence |
|---|---|---|---|---|---|---|---|
| hsa-mir-511 | MI0003127 | — | chr10 | 17845107 | 17845193 | + | ✓ |
| hsa-mir-5100 | MI0019116 | 107 | chr10 | 42997563 | 42997681 | + | — |
| hsa-mir-510 | MI0003197 | 20 | chrX | 147272335 | 147272408 | – | ✓ |
| hsa-mir-5094 | MI0017983 | — | chr15 | 89850637 | 89850721 | – | — |
| hsa-mir-5093 | MI0017982 | 38 | chr16 | 85306226 | 85306325 | – | — |
| hsa-mir-5092 | MI0017981 | — | chr3 | 125151465 | 125151552 | – | — |
| hsa-mir-5091 | MI0017980 | 6 | chr4 | 13627865 | 13627957 | + | — |
| hsa-mir-5090 | MI0017979 | 2 | chr7 | 102465742 | 102465826 | + | — |
| hsa-mir-509-3 | MI0005717 | 352 | chrX | 147259652 | 147259726 | – | ✓ |
| hsa-mir-509-2 | MI0005530 | 259 | chrX | 147258760 | 147258850 | – | ✓ |
| hsa-mir-509-1 | MI0003196 | 259 | chrX | 147260532 | 147260625 | – | ✓ |
| hsa-mir-5089 | MI0017978 | 34 | chr17 | 46973017 | 46973100 | + | — |
| hsa-mir-5088 | MI0017977 | — | chr19 | 49682117 | 49682195 | + | — |
| hsa-mir-5087 | MI0017976 | — | chr1 | 148334479 | 148334554 | – | — |
| hsa-mir-508 | MI0003195 | 347 | chrX | 147236913 | 147237027 | – | ✓ |
| hsa-mir-507 | MI0003194 | 20 | chrX | 147230984 | 147231077 | – | — |
| hsa-mir-506 | MI0003193 | 55 | chrX | 147230720 | 147230843 | – | ✓ |
| hsa-mir-505 | MI0003190 | 86 | chrX | 139924148 | 139924231 | – | — |
| hsa-mir-5047 | MI0017932 | — | chr17 | 64501214 | 64501313 | – | — |
| hsa-mir-504 | MI0003189 | 4 | chrX | 138667711 | 138667793 | – | ✓ |
| hsa-mir-503 | MI0003188 | 132 | chrX | 134546328 | 134546398 | – | ✓ |
| hsa-mir-502 | MI0003186 | 58 | chrX | 50014598 | 50014683 | + | ✓ |
| hsa-mir-5011 | MI0017879 | — | chr18 | 67081584 | 67081686 | + | — |
| hsa-mir-5010 | MI0017878 | 1 | chr17 | 42514188 | 42514307 | + | ✓ |
| hsa-mir-501 | MI0003185 | 53 | chrX | 50009722 | 50009805 | + | ✓ |
| hsa-mir-500b | MI0015903 | 13 | chrX | 50010672 | 50010750 | + | — |
| hsa-mir-500a | MI0003184 | 63 | chrX | 50008431 | 50008514 | + | ✓ |
| hsa-mir-5009 | MI0017877 | — | chr15 | 89883931 | 89884030 | – | — |
| hsa-mir-5008 | MI0017876 | 1 | chr1 | 227941590 | 227941683 | – | — |
| hsa-mir-5007 | MI0017874 | — | chr13 | 55174454 | 55174548 | + | — |
| hsa-mir-5006 | MI0017873 | 8 | chr13 | 41568286 | 41568395 | – | — |
| hsa-mir-5004 | MI0017870 | 7 | chr6 | 33438331 | 33438437 | + | — |
| hsa-mir-5003 | MI0017869 | 12 | chr5 | 172662165 | 172662263 | + | — |
| hsa-mir-5002 | MI0017868 | 9 | chr3 | 124132929 | 124133025 | + | — |
| hsa-mir-5001 | MI0017867 | — | chr2 | 232550474 | 232550573 | – | ✓ |
| hsa-mir-5000 | MI0017866 | 11 | chr2 | 75090812 | 75090914 | + | ✓ |
| hsa-mir-499b | MI0017396 | 6 | chr20 | 34990400 | 34990472 | – | — |
| hsa-mir-499a | MI0003183 | 382 | chr20 | 34990376 | 34990497 | + | ✓ |
| hsa-mir-4999 | MI0017865 | 13 | chr19 | 8389290 | 8389380 | – | — |

TABLE 2-continued

| miRNA ID | Accession | RPM | Chromosome | Start | End | Strand | Confidence |
|---|---|---|---|---|---|---|---|
| hsa-mir-498 | MI0003142 | 54 | chr19 | 53674197 | 53674320 | + | — |
| hsa-mir-497 | MI0003138 | 267 | chr17 | 7017911 | 7018022 | − | — |
| hsa-mir-496 | MI0003136 | — | chr14 | 101060573 | 101060674 | + | — |
| hsa-mir-495 | MI0003135 | 91 | chr14 | 101033755 | 101033836 | + | ✓ |
| hsa-mir-494 | MI0003134 | 10 | chr14 | 101029634 | 101029714 | + | — |
| hsa-mir-493 | MI0003132 | 10 | chr14 | 100869060 | 100869148 | + | ✓ |
| hsa-mir-492 | MI0003131 | — | chr12 | 94834398 | 94834513 | + | — |
| hsa-mir-491 | MI0003126 | 4 | chr9 | 20716105 | 20716188 | + | ✓ |
| hsa-mir-490 | MI0003125 | 13 | chr7 | 136903167 | 136903294 | + | ✓ |
| hsa-mir-489 | MI0003124 | — | chr7 | 93483936 | 93484019 | − | — |
| hsa-mir-488 | MI0003123 | 16 | chr1 | 177029363 | 177029445 | − | ✓ |
| hsa-mir-487b | MI0003530 | 23 | chr14 | 101046455 | 101046538 | + | — |
| hsa-mir-487a | MI0002471 | — | chr14 | 101052446 | 101052525 | + | ✓ |
| hsa-mir-486-2 | MI0023622 | 645 | chr8 | 41660444 | 41660507 | + | ✓ |
| hsa-mir-486-1 | MI0002470 | 650 | chr8 | 41660441 | 41660508 | − | ✓ |
| hsa-mir-485 | MI0002469 | 9 | chr14 | 101055419 | 101055491 | + | ✓ |
| hsa-mir-484 | MI0002468 | 435 | chr16 | 15643294 | 15643372 | + | — |
| hsa-mir-483 | MI0002467 | 83 | chr11 | 2134134 | 2134209 | − | ✓ |
| hsa-mir-4804 | MI0017452 | 3 | chr5 | 72878591 | 72878663 | + | — |
| hsa-mir-4803 | MI0017451 | — | chr5 | 72169467 | 72169540 | + | — |
| hsa-mir-4802 | MI0017450 | — | chr4 | 40502040 | 40502119 | − | ✓ |
| hsa-mir-4801 | MI0017449 | — | chr4 | 37241910 | 37241991 | − | — |
| hsa-mir-4800 | MI0017448 | 4 | chr4 | 2250077 | 2250156 | − | — |
| hsa-mir-4799 | MI0017446 | — | chr4 | 147782595 | 147782668 | + | — |
| hsa-mir-4798 | MI0017445 | — | chr4 | 7310450 | 7310524 | + | — |
| hsa-mir-4797 | MI0017444 | — | chr3 | 197293878 | 197293948 | − | — |
| hsa-mir-4796 | MI0017443 | — | chr3 | 114743445 | 114743525 | − | — |
| hsa-mir-4795 | MI0017442 | — | chr3 | 87226189 | 87226277 | − | — |
| hsa-mir-4794 | MI0017441 | — | chr1 | 64579847 | 64579923 | + | — |
| hsa-mir-4793 | MI0017440 | 8 | chr3 | 48644194 | 48644280 | − | — |
| hsa-mir-4791 | MI0017438 | 3 | chr3 | 19314848 | 19314931 | − | — |
| hsa-mir-4790 | MI0017437 | 52 | chr3 | 5250177 | 5250255 | − | — |
| hsa-mir-4789 | MI0017436 | — | chr3 | 175369540 | 175369621 | + | — |
| hsa-mir-4788 | MI0017435 | 4 | chr3 | 134437827 | 134437906 | + | — |
| hsa-mir-4787 | MI0017434 | 4 | chr3 | 50675080 | 50675163 | + | — |
| hsa-mir-4786 | MI0017433 | — | chr2 | 239943015 | 239943094 | − | ✓ |
| hsa-mir-4785 | MI0017430 | — | chr2 | 160407810 | 160407882 | − | — |
| hsa-mir-4784 | MI0017429 | — | chr2 | 131491160 | 131491236 | − | — |
| hsa-mir-4783 | MI0017428 | — | chr2 | 127423537 | 127423618 | − | — |

TABLE 2-continued

| miRNA ID | Accession | RPM | Chromosome | Start | End | Strand | Confidence |
|---|---|---|---|---|---|---|---|
| hsa-mir-4782 | MI0017427 | — | chr2 | 113721290 | 113721368 | − | — |
| hsa-mir-4781 | MI0017426 | — | chr1 | 54054079 | 54054154 | + | — |
| hsa-mir-4780 | MI0017424 | — | chr2 | 88082519 | 88082599 | − | — |
| hsa-mir-4779 | MI0017423 | 11 | chr2 | 86193026 | 86193108 | − | — |
| hsa-mir-4778 | MI0017422 | 2 | chr2 | 66358249 | 66358328 | − | ✓ |
| hsa-mir-4777 | MI0017421 | — | chr2 | 231362708 | 231362793 | + | — |
| hsa-mir-4776-2 | MI0017420 | 114 | chr2 | 212926257 | 212926336 | − | — |
| hsa-mir-4776-1 | MI0017419 | 8 | chr2 | 212926257 | 212926336 | + | — |
| hsa-mir-4775 | MI0017418 | — | chr2 | 207754807 | 207754881 | + | — |
| hsa-mir-4774 | MI0017417 | — | chr2 | 168582943 | 168583018 | + | — |
| hsa-mir-4773-2 | MI0017416 | 18 | chr2 | 151368334 | 151368411 | − | — |
| hsa-mir-4773-1 | MI0017415 | 17 | chr2 | 151368334 | 151368411 | + | — |
| hsa-mir-4772 | MI0017414 | 1 | chr2 | 102432289 | 102432366 | + | — |
| hsa-mir-4771-2 | MI0017413 | — | chr2 | 111771061 | 111771134 | − | — |
| hsa-mir-4771-1 | MI0017412 | — | chr2 | 87194786 | 87194859 | + | — |
| hsa-mir-4770 | MI0017411 | — | chrX | 6383906 | 6383963 | − | — |
| hsa-mir-4769 | MI0017410 | — | chrX | 47587429 | 47587505 | + | — |
| hsa-mir-4768 | MI0017409 | — | chrX | 17425881 | 17425954 | + | — |
| hsa-mir-4767 | MI0017408 | 2 | chrX | 7147860 | 7147937 | + | — |
| hsa-mir-4766 | MI0017407 | 1 | chr22 | 40813883 | 40813958 | − | — |
| hsa-mir-4765 | MI0017406 | — | chr2 | 32635255 | 32635331 | + | — |
| hsa-mir-4764 | MI0017405 | — | chr22 | 33436582 | 33436669 | − | — |
| hsa-mir-4763 | MI0017404 | 5 | chr22 | 46113566 | 46113657 | + | — |
| hsa-mir-4762 | MI0017403 | — | chr22 | 45760524 | 45760598 | + | — |
| hsa-mir-4761 | MI0017402 | 8 | chr22 | 19963753 | 19963834 | + | ✓ |
| hsa-mir-4760 | MI0017401 | — | chr21 | 40212352 | 40212431 | − | — |
| hsa-mir-4759 | MI0017400 | — | chr21 | 26953961 | 26954043 | + | — |
| hsa-mir-4758 | MI0017399 | — | chr20 | 62332487 | 62332557 | − | — |
| hsa-mir-4757 | MI0017398 | — | chr2 | 19348429 | 19348505 | + | — |
| hsa-mir-4756 | MI0017397 | 11 | chr20 | 54068408 | 54068485 | − | — |
| hsa-mir-4755 | MI0017395 | — | chr20 | 34049119 | 34049190 | + | ✓ |
| hsa-mir-4754 | MI0017394 | — | chr19 | 58386770 | 58386858 | − | — |
| hsa-mir-4753 | MI0017392 | 1 | chr1 | 235190034 | 235190116 | − | — |
| hsa-mir-4752 | MI0017391 | — | chr19 | 54282109 | 54282180 | + | — |
| hsa-mir-4751 | MI0017390 | — | chr19 | 49933064 | 49933137 | + | — |
| hsa-mir-4750 | MI0017389 | — | chr19 | 49888175 | 49888230 | + | — |
| hsa-mir-4749 | MI0017388 | 9 | chr19 | 49854591 | 49854651 | + | — |
| hsa-mir-4748 | MI0017387 | — | chr19 | 10780254 | 10780335 | + | — |
| hsa-mir-4747 | MI0017386 | — | chr19 | 4932687 | 4932740 | + | — |

TABLE 2-continued

| miRNA ID | Accession | RPM | Chromosome | Start | End | Strand | Confidence |
|---|---|---|---|---|---|---|---|
| hsa-mir-4746 | MI0017385 | — | chr19 | 4445978 | 4446048 | + | — |
| hsa-mir-4745 | MI0017384 | — | chr19 | 804940 | 805001 | + | — |
| hsa-mir-4744 | MI0017382 | — | chr18 | 49049687 | 49049768 | − | — |
| hsa-mir-4743 | MI0017381 | — | chr18 | 48670600 | 48670668 | + | — |
| hsa-mir-4742 | MI0017380 | — | chr1 | 224398227 | 224398311 | − | — |
| hsa-mir-4741 | MI0017379 | — | chr18 | 22933349 | 22933438 | + | — |
| hsa-mir-4740 | MI0017378 | 26 | chr17 | 81400716 | 81400778 | − | — |
| hsa-mir-4739 | MI0017377 | 166 | chr17 | 79707176 | 79707249 | − | — |
| hsa-mir-4738 | MI0017376 | 3 | chr17 | 75784521 | 75784607 | − | — |
| hsa-mir-4737 | MI0017374 | — | chr17 | 60043025 | 60043105 | − | — |
| hsa-mir-4736 | MI0017373 | 282 | chr17 | 58335976 | 58336022 | − | — |
| hsa-mir-4735 | MI0017372 | 75 | chr1 | 196582413 | 196582481 | − | — |
| hsa-mir-4734 | MI0017371 | 2 | chr17 | 38702262 | 38702331 | − | — |
| hsa-mir-4733 | MI0017370 | — | chr17 | 31094350 | 31094425 | − | — |
| hsa-mir-4732 | MI0017369 | 1 | chr17 | 28861655 | 28861730 | − | — |
| hsa-mir-4731 | MI0017368 | — | chr17 | 15251627 | 15251696 | − | — |
| hsa-mir-4730 | MI0017367 | 8 | chr17 | 80419418 | 80419493 | + | — |
| hsa-mir-4729 | MI0017366 | — | chr17 | 59366083 | 59366154 | + | — |
| hsa-mir-4728 | MI0017365 | — | chr17 | 39726495 | 39726561 | + | — |
| hsa-mir-4727 | MI0017364 | — | chr17 | 38825838 | 38825892 | + | — |
| hsa-mir-4726 | MI0017363 | — | chr17 | 38719691 | 38719748 | + | — |
| hsa-mir-4725 | MI0017362 | 24 | chr17 | 31575269 | 31575358 | + | — |
| hsa-mir-4724 | MI0017361 | 2 | chr17 | 31534883 | 31534971 | + | — |
| hsa-mir-4723 | MI0017359 | 1 | chr17 | 28360654 | 28360734 | + | — |
| hsa-mir-4722 | MI0017357 | 11 | chr16 | 88716278 | 88716337 | − | — |
| hsa-mir-4721 | MI0017356 | — | chr16 | 28843919 | 28844007 | − | — |
| hsa-mir-4720 | MI0017355 | — | chr16 | 81385018 | 81385093 | + | — |
| hsa-mir-4719 | MI0017354 | 41 | chr16 | 76868936 | 76869019 | + | — |
| hsa-mir-4718 | MI0017353 | — | chr16 | 12720321 | 12720371 | + | — |
| hsa-mir-4717 | MI0017352 | — | chr16 | 2274620 | 2274691 | + | — |
| hsa-mir-4716 | MI0017350 | 5 | chr15 | 49169070 | 49169153 | − | — |
| hsa-mir-4715 | MI0017349 | — | chr15 | 25848747 | 25848825 | − | — |
| hsa-mir-4714 | MI0017348 | — | chr15 | 98784426 | 98784502 | + | — |
| hsa-mir-4713 | MI0017347 | 4 | chr15 | 51242190 | 51242264 | + | — |
| hsa-mir-4712 | MI0017346 | — | chr15 | 50360329 | 50360410 | + | — |
| hsa-mir-4711 | MI0017345 | — | chr1 | 59733227 | 59733296 | − | — |
| hsa-mir-4710 | MI0017344 | 2 | chr14 | 104677694 | 104677749 | − | — |
| hsa-mir-4709 | MI0017342 | 4 | chr14 | 74480133 | 74480204 | − | — |
| hsa-mir-4708 | MI0017341 | 8 | chr14 | 65335117 | 65335183 | − | — |

TABLE 2-continued

| miRNA ID | Accession | RPM | Chromosome | Start | End | Strand | Confidence |
|---|---|---|---|---|---|---|---|
| hsa-mir-4707 | MI0017340 | — | chr14 | 22956950 | 22957029 | − | — |
| hsa-mir-4706 | MI0017339 | 8 | chr14 | 65044688 | 65044769 | + | — |
| hsa-mir-4705 | MI0017338 | — | chr13 | 102045934 | 102046004 | − | — |
| hsa-mir-4704 | MI0017337 | — | chr13 | 66218250 | 66218324 | + | ✓ |
| hsa-mir-4703 | MI0017336 | — | chr13 | 51552589 | 51552667 | + | — |
| hsa-mir-4701 | MI0017334 | — | chr12 | 48771975 | 48772037 | − | — |
| hsa-mir-4700 | MI0017333 | — | chr12 | 120723193 | 120723266 | + | — |
| hsa-mir-4699 | MI0017332 | 29 | chr12 | 81158388 | 81158461 | + | — |
| hsa-mir-4698 | MI0017331 | — | chr12 | 47187812 | 47187891 | + | — |
| hsa-mir-4697 | MI0017330 | — | chr11 | 133898504 | 133898581 | − | — |
| hsa-mir-4696 | MI0017329 | — | chr11 | 74720268 | 74720337 | − | — |
| hsa-mir-4695 | MI0017328 | 2 | chr1 | 18883202 | 18883275 | − | — |
| hsa-mir-4694 | MI0017327 | 75 | chr11 | 19760004 | 19760083 | − | — |
| hsa-mir-4693 | MI0017326 | 5 | chr11 | 103849906 | 103849980 | + | — |
| hsa-mir-4692 | MI0017325 | — | chr11 | 72783530 | 72783592 | + | — |
| hsa-mir-4691 | MI0017324 | 9 | chr11 | 68033897 | 68033981 | + | — |
| hsa-mir-4690 | MI0017323 | — | chr11 | 65636310 | 65636369 | + | — |
| hsa-mir-4689 | MI0017322 | 30 | chr1 | 5862672 | 5862741 | − | — |
| hsa-mir-4688 | MI0017321 | 50 | chr11 | 46376402 | 46376484 | + | — |
| hsa-mir-4687 | MI0017319 | 5 | chr11 | 3856062 | 3856141 | + | — |
| hsa-mir-4686 | MI0017318 | 18 | chr11 | 2173063 | 2173138 | + | — |
| hsa-mir-4685 | MI0017317 | 26 | chr10 | 98431292 | 98431360 | − | — |
| hsa-mir-4684 | MI0017316 | 2 | chr1 | 22719517 | 22719598 | + | — |
| hsa-mir-4683 | MI0017315 | 1 | chr10 | 35641172 | 35641252 | − | — |
| hsa-mir-4682 | MI0017314 | — | chr10 | 119958513 | 119958592 | + | — |
| hsa-mir-4681 | MI0017313 | 19 | chr10 | 119377972 | 119378043 | + | — |
| hsa-mir-4680 | MI0017312 | — | chr10 | 110898090 | 110898155 | + | — |
| hsa-mir-4679-2 | MI0017311 | 4 | chr10 | 89063335 | 89063411 | − | — |
| hsa-mir-4679-1 | MI0017310 | 4 | chr10 | 89063336 | 89063410 | + | — |
| hsa-mir-4678 | MI0017309 | — | chr10 | 87503881 | 87503954 | + | — |
| hsa-mir-4677 | MI0017308 | 1 | chr1 | 243346176 | 243346255 | + | ✓ |
| hsa-mir-4676 | MI0017307 | — | chr10 | 72721029 | 72721100 | + | — |
| hsa-mir-4675 | MI0017306 | — | chr10 | 20551970 | 20552046 | + | — |
| hsa-mir-4674 | MI0017305 | 8 | chr9 | 136546173 | 136546259 | − | — |
| hsa-mir-4673 | MI0017304 | — | chr9 | 136519568 | 136519626 | − | — |
| hsa-mir-4672 | MI0017303 | 46 | chr9 | 127869415 | 127869495 | − | — |
| hsa-mir-4671 | MI0017302 | — | chr1 | 234306467 | 234306539 | + | — |
| hsa-mir-4670 | MI0017301 | — | chr9 | 92527984 | 92528058 | − | — |
| hsa-mir-4669 | MI0017300 | 2 | chr9 | 134379411 | 134379472 | + | — |

TABLE 2-continued

| miRNA ID | Accession | RPM | Chromosome | Start | End | Strand | Confidence |
|----------|-----------|-----|------------|-------|-----|--------|------------|
| hsa-mir-4668 | MI0017298 | — | chr9 | 111932100 | 111932169 | + | — |
| hsa-mir-4667 | MI0017297 | 3 | chr9 | 35608094 | 35608159 | + | — |
| hsa-mir-4666b | MI0019299 | — | chrX | 29574278 | 29574358 | + | — |
| hsa-mir-4666a | MI0017296 | — | chr1 | 228462074 | 228462152 | + | — |
| hsa-mir-4665 | MI0017295 | — | chr9 | 6007826 | 6007904 | + | — |
| hsa-mir-4664 | MI0017294 | — | chr8 | 143733083 | 143733153 | − | — |
| hsa-mir-4663 | MI0017292 | 110 | chr8 | 123215788 | 123215863 | − | — |
| hsa-mir-4662b | MI0017293 | 1 | chr8 | 124821978 | 124822058 | − | — |
| hsa-mir-4662a | MI0017290 | 2 | chr8 | 124821985 | 124822051 | + | — |
| hsa-mir-4661 | MI0017289 | — | chr8 | 91205485 | 91205559 | + | — |
| hsa-mir-4660 | MI0017288 | 22 | chr8 | 9048445 | 9048518 | + | — |
| hsa-mir-466 | MI0014157 | 13 | chr3 | 31161704 | 31161787 | − | — |
| hsa-mir-4659b | MI0017291 | — | chr8 | 6745168 | 6745240 | − | — |
| hsa-mir-4659a | MI0017287 | 2 | chr8 | 6745164 | 6745244 | + | — |
| hsa-mir-4658 | MI0017286 | — | chr7 | 100156605 | 100156669 | − | — |
| hsa-mir-4657 | MI0017285 | — | chr7 | 44881748 | 44881800 | − | — |
| hsa-mir-4656 | MI0017284 | 11 | chr7 | 4788565 | 4788639 | − | — |
| hsa-mir-4655 | MI0017283 | 2 | chr7 | 1844180 | 1844253 | − | — |
| hsa-mir-4654 | MI0017282 | — | chr1 | 162157107 | 162157182 | + | — |
| hsa-mir-4653 | MI0017281 | — | chr7 | 101159473 | 101159555 | + | — |
| hsa-mir-4652 | MI0017280 | — | chr7 | 93716928 | 93717005 | + | — |
| hsa-mir-4651 | MI0017279 | 5 | chr7 | 75915197 | 75915269 | + | — |
| hsa-mir-4650-2 | MI0017278 | — | chr7 | 72697903 | 72697978 | + | — |
| hsa-mir-4650-1 | MI0017277 | — | chr7 | 67114322 | 67114397 | − | — |
| hsa-mir-4649 | MI0017276 | — | chr7 | 44110849 | 44110912 | + | — |
| hsa-mir-4648 | MI0017275 | — | chr7 | 2527074 | 2527145 | + | — |
| hsa-mir-4647 | MI0017274 | 5 | chr6 | 44254206 | 44254285 | − | — |
| hsa-mir-4646 | MI0017273 | — | chr6 | 31701029 | 31701091 | − | — |
| hsa-mir-4645 | MI0017272 | — | chr6 | 2854031 | 2854107 | − | — |
| hsa-mir-4644 | MI0017271 | 5 | chr6 | 170330761 | 170330844 | + | — |
| hsa-mir-4643 | MI0017270 | — | chr6 | 91521660 | 91521737 | + | — |
| hsa-mir-4642 | MI0017269 | — | chr6 | 44435641 | 44435722 | + | — |
| hsa-mir-4641 | MI0017268 | 33 | chr6 | 41598723 | 41598788 | + | — |
| hsa-mir-4640 | MI0017267 | 3 | chr6 | 30890883 | 30890972 | + | — |
| hsa-mir-4639 | MI0017266 | — | chr6 | 16141556 | 16141624 | + | — |
| hsa-mir-4638 | MI0017265 | 1 | chr5 | 181222566 | 181222633 | − | — |
| hsa-mir-4637 | MI0017264 | — | chr5 | 14825929 | 14826012 | − | — |
| hsa-mir-4636 | MI0017263 | — | chr5 | 9053816 | 9053895 | − | — |
| hsa-mir-4635 | MI0017262 | 2 | chr5 | 1062896 | 1062974 | − | — |

TABLE 2-continued

| miRNA ID | Accession | RPM | Chromosome | Start | End | Strand | Confidence |
|---|---|---|---|---|---|---|---|
| hsa-mir-4634 | MI0017261 | — | chr5 | 174751734 | 174751787 | + | — |
| hsa-mir-4633 | MI0017260 | — | chr5 | 129097688 | 129097766 | + | — |
| hsa-mir-4632 | MI0017259 | — | chr1 | 12191713 | 12191773 | + | — |
| hsa-mir-455 | MI0003513 | 353 | chr9 | 114209434 | 114209529 | + | — |
| hsa-mir-4540 | MI0016911 | — | chr9 | 36864254 | 36864308 | − | — |
| hsa-mir-454 | MI0003820 | 207 | chr17 | 59137758 | 59137872 | − | ✓ |
| hsa-mir-4539 | MI0016910 | 8 | chr14 | 105857513 | 105857572 | − | — |
| hsa-mir-4538 | MI0016909 | 2 | chr14 | 105858165 | 105858242 | − | — |
| hsa-mir-4537 | MI0016908 | 2 | chr14 | 105859484 | 105859553 | − | — |
| hsa-mir-4536-2 | MI0019149 | 70 | chrX | 55451495 | 55451582 | + | — |
| hsa-mir-4536-1 | MI0016906 | — | chrX | 55451495 | 55451582 | − | — |
| hsa-mir-4535 | MI0016903 | — | chr22 | 48780295 | 48780353 | + | — |
| hsa-mir-4534 | MI0016901 | — | chr22 | 37988794 | 37988853 | + | — |
| hsa-mir-4533 | MI0016900 | 22 | chr20 | 60478111 | 60478181 | + | — |
| hsa-mir-4531 | MI0016898 | 42 | chr19 | 44653686 | 44653732 | − | — |
| hsa-mir-4530 | MI0016897 | — | chr19 | 39409623 | 39409678 | − | — |
| hsa-mir-4529 | MI0016896 | — | chr18 | 55479221 | 55479298 | + | — |
| hsa-mir-4528 | MI0016895 | — | chr18 | 53237101 | 53237190 | + | — |
| hsa-mir-4527 | MI0016894 | — | chr18 | 47380496 | 47380565 | + | — |
| hsa-mir-4526 | MI0016893 | — | chr18 | 13611114 | 13611200 | + | — |
| hsa-mir-4525 | MI0016892 | 4 | chr17 | 82668233 | 82668307 | − | — |
| hsa-mir-4524b | MI0019114 | 45 | chr17 | 69099542 | 69099656 | + | — |
| hsa-mir-4524a | MI0016891 | — | chr17 | 69099564 | 69099632 | − | ✓ |
| hsa-mir-4523 | MI0016890 | — | chr17 | 29390662 | 29390730 | + | — |
| hsa-mir-4522 | MI0016889 | — | chr17 | 27293910 | 27293996 | − | — |
| hsa-mir-4521 | MI0016887 | 654 | chr17 | 8186945 | 8187004 | + | — |
| hsa-mir-4520-2 | MI0017358 | — | chr17 | 6655449 | 6655502 | + | — |
| hsa-mir-4520-1 | MI0016886 | — | chr17 | 6655440 | 6655509 | − | — |
| hsa-mir-452 | MI0001733 | 123 | chrX | 151959628 | 151959712 | − | ✓ |
| hsa-mir-451b | MI0017360 | — | chr17 | 28861371 | 28861438 | + | — |
| hsa-mir-451a | MI0001729 | 3855 | chr17 | 28861369 | 28861440 | − | — |
| hsa-mir-4519 | MI0016885 | — | chr16 | 30875266 | 30875323 | − | — |
| hsa-mir-4518 | MI0016884 | 2 | chr16 | 30503919 | 30504001 | + | — |
| hsa-mir-4517 | MI0016883 | 10 | chr16 | 28958583 | 28958661 | + | — |
| hsa-mir-4516 | MI0016882 | 229 | chr16 | 2133119 | 2133204 | + | — |
| hsa-mir-4515 | MI0016881 | 4 | chr15 | 83067335 | 83067415 | + | — |
| hsa-mir-4514 | MI0016880 | — | chr15 | 80997417 | 80997473 | − | — |
| hsa-mir-4513 | MI0016879 | 16 | chr15 | 74788672 | 74788757 | − | — |
| hsa-mir-4512 | MI0016878 | 11 | chr15 | 66496958 | 66497034 | − | — |

TABLE 2-continued

| miRNA ID | Accession | RPM | Chromosome | Start | End | Strand | Confidence |
|---|---|---|---|---|---|---|---|
| hsa-mir-4511 | MI0016877 | 6 | chr15 | 65719246 | 65719332 | – | – |
| hsa-mir-4510 | MI0016876 | 237 | chr15 | 35926856 | 35926923 | + | – |
| hsa-mir-450b | MI0005531 | 27 | chrX | 134540185 | 134540262 | – | ✓ |
| hsa-mir-450a-2 | MI0003187 | 275 | chrX | 134540508 | 134540607 | – | ✓ |
| hsa-mir-450a-1 | MI0001652 | 275 | chrX | 134540341 | 134540431 | – | ✓ |
| hsa-mir-4509-3 | MI0016875 | – | chr15 | 28490752 | 28490845 | – | – |
| hsa-mir-4509-2 | MI0016874 | – | chr15 | 28426491 | 28426584 | + | – |
| hsa-mir-4509-1 | MI0016873 | – | chr15 | 23197827 | 23197920 | + | – |
| hsa-mir-4508 | MI0016872 | 31 | chr15 | 23562062 | 23562131 | – | – |
| hsa-mir-4507 | MI0016871 | – | chr14 | 105858124 | 105858175 | – | – |
| hsa-mir-4506 | MI0016869 | – | chr14 | 93948226 | 93948302 | – | – |
| hsa-mir-4505 | MI0016868 | – | chr14 | 73758747 | 73758819 | + | – |
| hsa-mir-4504 | MI0016867 | – | chr14 | 50299855 | 50299946 | – | – |
| hsa-mir-4503 | MI0016866 | 119 | chr14 | 36952309 | 36952391 | – | – |
| hsa-mir-4502 | MI0016865 | – | chr13 | 114273828 | 114273908 | + | – |
| hsa-mir-4501 | MI0016864 | – | chr13 | 96427229 | 96427292 | + | – |
| hsa-mir-4500 | MI0016863 | 106 | chr13 | 87618665 | 87618740 | – | – |
| hsa-mir-449c | MI0003823 | 9 | chr5 | 55172262 | 55172353 | – | – |
| hsa-mir-449b | MI0003673 | 120 | chr5 | 55170646 | 55170742 | – | – |
| hsa-mir-449a | MI0001648 | 102 | chr5 | 55170532 | 55170622 | – | – |
| hsa-mir-4499 | MI0016862 | – | chr13 | 20433778 | 20433846 | – | – |
| hsa-mir-4498 | MI0016860 | 46 | chr12 | 120155434 | 120155499 | – | – |
| hsa-mir-4497 | MI0016859 | 96 | chr12 | 109833348 | 109833436 | + | – |
| hsa-mir-4496 | MI0016858 | – | chr12 | 108635810 | 108635870 | + | – |
| hsa-mir-4495 | MI0016857 | – | chr12 | 97939056 | 97939121 | – | – |
| hsa-mir-4494 | MI0016856 | – | chr12 | 47364186 | 47364269 | – | – |
| hsa-mir-4493 | MI0016855 | 23 | chr11 | 123381440 | 123381512 | – | – |
| hsa-mir-4492 | MI0016854 | 12 | chr11 | 118910708 | 118910787 | + | – |
| hsa-mir-4491 | MI0016853 | – | chr11 | 111347757 | 111347824 | + | – |
| hsa-mir-4490 | MI0016852 | – | chr11 | 90555774 | 90555857 | – | – |
| hsa-mir-4489 | MI0016850 | – | chr11 | 65649192 | 65649253 | + | – |
| hsa-mir-4488 | MI0016849 | 67 | chr11 | 61508596 | 61508657 | + | – |
| hsa-mir-4487 | MI0016848 | – | chr11 | 47400970 | 47401042 | + | ✓ |
| hsa-mir-4486 | MI0016847 | – | chr11 | 19575310 | 19575372 | + | – |
| hsa-mir-4485 | MI0016846 | 20 | chr11 | 10508270 | 10508326 | – | – |
| hsa-mir-4484 | MI0016845 | 24 | chr10 | 125819740 | 125819822 | + | – |
| hsa-mir-4483 | MI0016844 | – | chr10 | 113777993 | 113778054 | – | – |
| hsa-mir-4482 | MI0016843 | – | chr10 | 104268336 | 104268405 | – | – |
| hsa-mir-4481 | MI0016842 | – | chr10 | 12653138 | 12653197 | – | – |

TABLE 2-continued

| miRNA ID | Accession | RPM | Chromosome | Start | End | Strand | Confidence |
|---|---|---|---|---|---|---|---|
| hsa-mir-4480 | MI0016841 | 100 | chr10 | 12578753 | 12578823 | + | — |
| hsa-mir-448 | MI0001637 | — | chrX | 114823454 | 114823564 | + | — |
| hsa-mir-4479 | MI0016838 | — | chr9 | 136886733 | 136886803 | + | — |
| hsa-mir-4478 | MI0016831 | — | chr9 | 122120082 | 122120167 | − | — |
| hsa-mir-4477b | MI0016830 | 11 | chr9 | 41233755 | 41233835 | − | — |
| hsa-mir-4477a | MI0016829 | 3 | chr9 | 41233755 | 41233835 | + | — |
| hsa-mir-4476 | MI0016828 | — | chr9 | 36893462 | 36893531 | − | — |
| hsa-mir-4475 | MI0016827 | — | chr9 | 36823539 | 36823599 | − | — |
| hsa-mir-4474 | MI0016826 | — | chr9 | 20502265 | 20502342 | − | — |
| hsa-mir-4473 | MI0016825 | — | chr9 | 20411148 | 20411238 | − | — |
| hsa-mir-4472-2 | MI0016824 | 65 | chr12 | 116428252 | 116428318 | − | — |
| hsa-mir-4472-1 | MI0016823 | 24 | chr8 | 142176339 | 142176418 | + | — |
| hsa-mir-4471 | MI0016822 | — | chr8 | 100382763 | 100382845 | + | — |
| hsa-mir-4470 | MI0016821 | — | chr8 | 61714788 | 61714859 | + | — |
| hsa-mir-4469 | MI0016820 | — | chr8 | 42896197 | 42896275 | − | — |
| hsa-mir-4468 | MI0016819 | — | chr7 | 138123758 | 138123821 | + | — |
| hsa-mir-4467 | MI0016818 | — | chr7 | 102471469 | 102471531 | + | — |
| hsa-mir-4466 | MI0016817 | 1 | chr6 | 156779678 | 156779731 | − | — |
| hsa-mir-4465 | MI0016816 | — | chr6 | 140683814 | 140683883 | + | — |
| hsa-mir-4464 | MI0016812 | — | chr6 | 90312742 | 90312833 | + | — |
| hsa-mir-4463 | MI0016811 | — | chr6 | 75428407 | 75428473 | + | — |
| hsa-mir-4462 | MI0016810 | — | chr6 | 37555365 | 37555422 | − | — |
| hsa-mir-4460 | MI0016806 | — | chr5 | 129397062 | 129397147 | − | — |
| hsa-mir-4458 | MI0016804 | — | chr5 | 8460925 | 8460999 | + | — |
| hsa-mir-4457 | MI0016803 | — | chr5 | 1309310 | 1309377 | − | — |
| hsa-mir-4456 | MI0016802 | — | | | | | — |
| hsa-mir-4455 | MI0016801 | 30 | chr4 | 184938383 | 184938440 | − | — |
| hsa-mir-4454 | MI0016800 | 457 | chr4 | 163093574 | 163093628 | − | — |
| hsa-mir-4453 | MI0016799 | — | chr4 | 152536428 | 152536516 | + | — |
| hsa-mir-4452 | MI0016798 | 7 | chr4 | 86542482 | 86542552 | − | — |
| hsa-mir-4451 | MI0016797 | 13 | chr4 | 85722468 | 85722533 | + | — |
| hsa-mir-4450 | MI0016795 | — | chr4 | 76573568 | 76573632 | + | — |
| hsa-mir-4449 | MI0016792 | 943 | chr4 | 52712682 | 52712747 | + | — |
| hsa-mir-4448 | MI0016791 | 59 | chr3 | 183886800 | 183886885 | + | — |
| hsa-mir-4447 | MI0016790 | — | chr3 | 116850277 | 116850367 | − | — |
| hsa-mir-4446 | MI0016789 | 1 | chr3 | 113594876 | 113594942 | + | — |
| hsa-mir-4445 | MI0016788 | 100 | chr3 | 109602828 | 109602897 | + | — |
| hsa-mir-4444-2 | MI0019111 | 9 | chr3 | 75214476 | 75214549 | + | — |
| hsa-mir-4444-1 | MI0016787 | 9 | chr2 | 177212726 | 177212799 | + | — |

TABLE 2-continued

| miRNA ID | Accession | RPM | Chromosome | Start | End | Strand | Confidence |
|---|---|---|---|---|---|---|---|
| hsa-mir-4443 | MI0016786 | 872 | chr3 | 48196564 | 48196616 | + | — |
| hsa-mir-4442 | MI0016785 | 6 | chr3 | 25664873 | 25664939 | − | — |
| hsa-mir-4441 | MI0016784 | — | chr2 | 239085827 | 239085926 | − | — |
| hsa-mir-4440 | MI0016783 | — | chr2 | 239068817 | 239068914 | − | — |
| hsa-mir-4439 | MI0016782 | — | chr2 | 225010461 | 225010540 | − | — |
| hsa-mir-4438 | MI0016781 | 138 | chr2 | 213758067 | 213758159 | + | — |
| hsa-mir-4437 | MI0016778 | — | chr2 | 181305593 | 181305652 | − | — |
| hsa-mir-4436b-2 | MI0019110 | 7 | chr2 | 110284853 | 110284943 | + | — |
| hsa-mir-4436b-1 | MI0017425 | 7 | chr2 | 110086433 | 110086523 | − | — |
| hsa-mir-4436a | MI0016776 | — | chr2 | 88812370 | 88812454 | + | — |
| hsa-mir-4435-2 | MI0016777 | — | chr2 | 111321013 | 111321086 | − | — |
| hsa-mir-4435-1 | MI0016775 | — | chr2 | 87629755 | 87629834 | + | — |
| hsa-mir-4434 | MI0016774 | — | chr2 | 64525513 | 64525565 | + | — |
| hsa-mir-4433b | MI0025511 | — | chr2 | 64340747 | 64340848 | − | — |
| hsa-mir-4433a | MI0016773 | 5 | chr2 | 64340759 | 64340839 | + | — |
| hsa-mir-4432 | MI0016772 | 16 | chr2 | 60387362 | 60387445 | − | — |
| hsa-mir-4431 | MI0016771 | 5 | chr2 | 52702522 | 52702615 | − | — |
| hsa-mir-4430 | MI0016769 | 12 | chr2 | 33418516 | 33418564 | + | — |
| hsa-mir-4429 | MI0016768 | 1989 | chr2 | 11540605 | 11540677 | − | — |
| hsa-mir-4428 | MI0016767 | — | chr1 | 237471119 | 237471191 | + | — |
| hsa-mir-4427 | MI0016766 | — | chr1 | 233624152 | 233624219 | + | — |
| hsa-mir-4426 | MI0016765 | — | chr1 | 192716328 | 192716390 | + | — |
| hsa-mir-4425 | MI0016764 | 14 | chr1 | 25023503 | 25023586 | + | — |
| hsa-mir-4424 | MI0016763 | — | chr1 | 178677749 | 178677834 | + | — |
| hsa-mir-4423 | MI0016760 | 10 | chr1 | 85133794 | 85133873 | + | ✓ |
| hsa-mir-4422 | MI0016759 | — | chr1 | 55225641 | 55225723 | + | — |
| hsa-mir-4421 | MI0016758 | — | chr1 | 51059837 | 51059905 | + | — |
| hsa-mir-4420 | MI0016757 | — | chr1 | 30739156 | 30739232 | − | — |
| hsa-mir-4418 | MI0016754 | 44 | chr1 | 22266239 | 22266300 | + | — |
| hsa-mir-4330 | MI0015902 | 11 | chrX | 151168222 | 151168326 | + | — |
| hsa-mir-433 | MI0001723 | 2 | chr14 | 100881886 | 100881978 | + | ✓ |
| hsa-mir-4329 | MI0015901 | 4 | chrX | 112780718 | 112780788 | − | — |
| hsa-mir-4328 | MI0015904 | 80 | chrX | 78901194 | 78901249 | − | — |
| hsa-mir-4327 | MI0015867 | 57 | chr21 | 30375294 | 30375378 | − | — |
| hsa-mir-4326 | MI0015866 | — | chr20 | 63286808 | 63286866 | + | — |
| hsa-mir-4325 | MI0015865 | — | chr20 | 57321502 | 57321591 | − | — |
| hsa-mir-4324 | MI0015854 | 56 | chr19 | 49308797 | 49308868 | − | — |
| hsa-mir-4323 | MI0015853 | — | chr19 | 42133445 | 42133513 | − | — |
| hsa-mir-4322 | MI0015851 | 9 | chr19 | 10230413 | 10230485 | + | — |

TABLE 2-continued

| miRNA ID | Accession | RPM | Chromosome | Start | End | Strand | Confidence |
|---|---|---|---|---|---|---|---|
| hsa-mir-4321 | MI0015852 | — | chr19 | 2250639 | 2250718 | + | — |
| hsa-mir-4320 | MI0015849 | — | chr18 | 50126499 | 50126563 | − | — |
| hsa-mir-432 | MI0003133 | 55 | chr14 | 100884483 | 100884576 | + | — |
| hsa-mir-4319 | MI0015848 | — | chr18 | 44970082 | 44970166 | − | — |
| hsa-mir-4318 | MI0015847 | 62 | chr18 | 37657135 | 37657215 | + | — |
| hsa-mir-4317 | MI0015850 | 1 | chr18 | 6374361 | 6374425 | − | — |
| hsa-mir-4316 | MI0015845 | 209 | chr17 | 77396984 | 77397054 | − | — |
| hsa-mir-4315-2 | MI0015983 | — | chr17 | 64822030 | 64822102 | − | — |
| hsa-mir-4315-1 | MI0015844 | — | chr17 | 45475363 | 45475435 | − | — |
| hsa-mir-4314 | MI0015846 | 150 | chr17 | 8088056 | 8088147 | + | — |
| hsa-mir-4313 | MI0015843 | 28 | chr15 | 75762215 | 75762315 | − | — |
| hsa-mir-4312 | MI0015842 | 57 | chr15 | 68801850 | 68801925 | − | — |
| hsa-mir-4311 | MI0015841 | 56 | chr15 | 66040233 | 66040332 | + | — |
| hsa-mir-4310 | MI0015840 | 77 | chr15 | 41866495 | 41866551 | − | — |
| hsa-mir-431 | MI0001721 | — | chr14 | 100881007 | 100881120 | + | — |
| hsa-mir-4309 | MI0015837 | — | chr14 | 102539644 | 102539726 | + | — |
| hsa-mir-4308 | MI0015839 | 6 | chr14 | 54878113 | 54878193 | − | — |
| hsa-mir-4307 | MI0015838 | — | chr14 | 26908642 | 26908725 | + | — |
| hsa-mir-4306 | MI0015836 | 135 | chr13 | 99643059 | 99643149 | + | — |
| hsa-mir-4305 | MI0015835 | 214 | chr13 | 39664034 | 39664135 | − | — |
| hsa-mir-4304 | MI0015832 | 13 | chr12 | 123010667 | 123010728 | − | — |
| hsa-mir-4303 | MI0015834 | — | chr12 | 97995383 | 97995448 | − | — |
| hsa-mir-4302 | MI0015833 | — | chr12 | 25874020 | 25874079 | − | — |
| hsa-mir-4301 | MI0015828 | 8 | chr11 | 113450023 | 113450088 | − | — |
| hsa-mir-4300 | MI0015831 | — | chr11 | 81890741 | 81890836 | − | — |
| hsa-mir-4299 | MI0015829 | — | chr11 | 11656651 | 11656722 | − | — |
| hsa-mir-4298 | MI0015830 | 9 | chr11 | 1859464 | 1859536 | − | — |
| hsa-mir-4297 | MI0015824 | — | chr10 | 129843299 | 129843374 | − | — |
| hsa-mir-4296 | MI0015823 | 6 | chr10 | 125032783 | 125032870 | − | — |
| hsa-mir-4295 | MI0015822 | — | chr10 | 112634170 | 112634254 | + | — |
| hsa-mir-4294 | MI0015827 | 171 | chr10 | 48985512 | 48985587 | − | — |
| hsa-mir-4293 | MI0015826 | — | chr10 | 14383200 | 14383277 | − | — |
| hsa-mir-4292 | MI0015897 | — | chr9 | 136830957 | 136831023 | + | — |
| hsa-mir-4291 | MI0015900 | — | chr9 | 93819357 | 93819421 | + | — |
| hsa-mir-4290 | MI0015899 | 145 | chr9 | 90023441 | 90023535 | − | — |
| hsa-mir-429 | MI0001641 | 381 | chr1 | 1169005 | 1169087 | + | — |
| hsa-mir-4289 | MI0015898 | 852 | chr9 | 88745836 | 88745905 | − | — |
| hsa-mir-4288 | MI0015896 | 8 | chr8 | 28505116 | 28505182 | − | — |
| hsa-mir-4287 | MI0015895 | — | chr8 | 27886039 | 27886116 | − | — |

TABLE 2-continued

| miRNA ID | Accession | RPM | Chromosome | Start | End | Strand | Confidence |
|---|---|---|---|---|---|---|---|
| hsa-mir-4286 | MI0015894 | 310 | chr8 | 10666978 | 10667070 | + | — |
| hsa-mir-4285 | MI0015891 | 7 | chr7 | 102293103 | 102293187 | + | — |
| hsa-mir-4284 | MI0015893 | 22 | chr7 | 73711317 | 73711397 | + | — |
| hsa-mir-4283-2 | MI0015982 | — | chr7 | 63621090 | 63621169 | + | — |
| hsa-mir-4283-1 | MI0015892 | — | chr7 | 56955785 | 56955864 | − | — |
| hsa-mir-4282 | MI0015890 | — | chr6 | 72967687 | 72967753 | − | — |
| hsa-mir-4281 | MI0015885 | 11 | chr5 | 176629439 | 176629500 | − | — |
| hsa-mir-4280 | MI0015889 | — | chr5 | 87114879 | 87114954 | − | — |
| hsa-mir-4279 | MI0015887 | 13 | chr5 | 31936102 | 31936159 | − | — |
| hsa-mir-4278 | MI0015888 | — | chr5 | 6827853 | 6827921 | − | — |
| hsa-mir-4277 | MI0015886 | — | chr5 | 1708785 | 1708868 | − | — |
| hsa-mir-4276 | MI0015882 | — | chr4 | 174423795 | 174423864 | + | — |
| hsa-mir-4275 | MI0015883 | 266 | chr4 | 28819582 | 28819668 | + | — |
| hsa-mir-4274 | MI0015884 | 33 | chr4 | 7460028 | 7460118 | + | — |
| hsa-mir-4273 | MI0015881 | — | chr3 | 75738280 | 75738363 | + | — |
| hsa-mir-4272 | MI0015880 | — | chr3 | 67225464 | 67225527 | + | — |
| hsa-mir-4271 | MI0015879 | 24 | chr3 | 49274120 | 49274186 | + | — |
| hsa-mir-4270 | MI0015878 | 14 | chr3 | 15496239 | 15496308 | − | — |
| hsa-mir-4269 | MI0015875 | — | chr2 | 239305462 | 239305545 | + | — |
| hsa-mir-4268 | MI0015874 | — | chr2 | 219906502 | 219906565 | − | — |
| hsa-mir-4267 | MI0015871 | — | chr2 | 110069961 | 110070042 | − | — |
| hsa-mir-4266 | MI0015870 | — | chr2 | 109313571 | 109313625 | − | — |
| hsa-mir-4265 | MI0015869 | 5 | chr2 | 109141490 | 109141588 | − | — |
| hsa-mir-4264 | MI0015877 | 877 | chr2 | 79649294 | 79649359 | − | — |
| hsa-mir-4263 | MI0015876 | — | chr2 | 27996367 | 27996449 | + | — |
| hsa-mir-4262 | MI0015872 | — | chr2 | 11836933 | 11836986 | − | — |
| hsa-mir-4261 | MI0015868 | — | chr2 | 10192614 | 10192671 | − | — |
| hsa-mir-4260 | MI0015859 | 350 | chr1 | 209623444 | 209623510 | − | — |
| hsa-mir-4259 | MI0015858 | 10 | chr1 | 159899979 | 159900079 | − | — |
| hsa-mir-4258 | MI0015857 | 9 | chr1 | 154975693 | 154975783 | + | — |
| hsa-mir-4257 | MI0015856 | 12 | chr1 | 150551929 | 150552014 | + | — |
| hsa-mir-4256 | MI0015855 | — | chr1 | 112461770 | 112461833 | − | — |
| hsa-mir-4255 | MI0015863 | — | chr1 | 37161563 | 37161634 | + | — |
| hsa-mir-4254 | MI0015862 | — | chr1 | 31758660 | 31758735 | − | — |
| hsa-mir-4253 | MI0015860 | — | chr1 | 22863159 | 22863226 | − | — |
| hsa-mir-4252 | MI0015864 | — | chr1 | 6429834 | 6429896 | − | — |
| hsa-mir-4251 | MI0015861 | — | chr1 | 3127975 | 3128035 | + | — |
| hsa-mir-425 | MI0001448 | 1131 | chr3 | 49020148 | 49020234 | − | ✓ |
| hsa-mir-424 | MI0001446 | 3666 | chrX | 134546614 | 134546711 | − | ✓ |

TABLE 2-continued

| miRNA ID | Accession | RPM | Chromosome | Start | End | Strand | Confidence |
|---|---|---|---|---|---|---|---|
| hsa-mir-423 | MI0001445 | 3706 | chr17 | 30117079 | 30117172 | + | ✓ |
| hsa-mir-422a | MI0001444 | 7 | chr15 | 63870930 | 63871019 | − | − |
| hsa-mir-421 | MI0003685 | 120 | chrX | 74218377 | 74218461 | − | ✓ |
| hsa-mir-412 | MI0002464 | — | chr14 | 101065447 | 101065537 | + | − |
| hsa-mir-411 | MI0003675 | 86 | chr14 | 101023325 | 101023420 | + | ✓ |
| hsa-mir-410 | MI0002465 | 12 | chr14 | 101065912 | 101065991 | + | ✓ |
| hsa-mir-409 | MI0001735 | 3 | chr14 | 101065300 | 101065378 | + | ✓ |
| hsa-mir-3978 | MI0016996 | — | chrX | 110082118 | 110082218 | + | − |
| hsa-mir-3977 | MI0016995 | — | chr5 | 82840155 | 82840224 | + | − |
| hsa-mir-3976 | MI0016994 | — | chr18 | 5840695 | 5840833 | + | − |
| hsa-mir-3975 | MI0016993 | 100 | chr18 | 35591737 | 35591806 | + | − |
| hsa-mir-3974 | MI0016992 | — | chr12 | 17673299 | 17673394 | + | − |
| hsa-mir-3973 | MI0016991 | 200 | chr11 | 36010098 | 36010204 | + | − |
| hsa-mir-3972 | MI0016990 | 122 | chr1 | 17277889 | 17277975 | + | − |
| hsa-mir-3960 | MI0016964 | 95 | chr9 | 127785833 | 127785923 | + | − |
| hsa-mir-3945 | MI0016602 | — | chr4 | 184851013 | 184851110 | − | − |
| hsa-mir-3944 | MI0016601 | 10 | chr10 | 133371556 | 133371663 | − | ✓ |
| hsa-mir-3943 | MI0016600 | — | chr7 | 43150895 | 43150994 | + | − |
| hsa-mir-3942 | MI0016599 | — | chr15 | 35372256 | 35372364 | − | ✓ |
| hsa-mir-3941 | MI0016598 | — | chr10 | 122416965 | 122417067 | + | − |
| hsa-mir-3940 | MI0016597 | — | chr19 | 6416410 | 6416511 | − | − |
| hsa-mir-3939 | MI0016596 | — | chr6 | 166997807 | 166997912 | − | − |
| hsa-mir-3938 | MI0016594 | — | chr3 | 55852492 | 55852594 | − | − |
| hsa-mir-3937 | MI0016593 | — | chrX | 39661216 | 39661321 | + | − |
| hsa-mir-3936 | MI0016592 | — | chr5 | 132365490 | 132365599 | − | − |
| hsa-mir-3935 | MI0016591 | 3 | chr16 | 56245520 | 56245623 | + | − |
| hsa-mir-3934 | MI0016590 | 1 | chr6 | 33698128 | 33698234 | + | − |
| hsa-mir-3929 | MI0016439 | 238 | chr18 | 35934088 | 35934142 | − | − |
| hsa-mir-3928 | MI0016438 | 1 | chr22 | 31160062 | 31160119 | − | − |
| hsa-mir-3927 | MI0016435 | — | chr9 | 109511475 | 109511545 | − | − |
| hsa-mir-3926-2 | MI0016437 | 6 | chr8 | 12727237 | 12727299 | + | − |
| hsa-mir-3926-1 | MI0016434 | 5 | chr8 | 12727232 | 12727304 | − | − |
| hsa-mir-3925 | MI0016433 | — | chr6 | 36622436 | 36622512 | − | − |
| hsa-mir-3924 | MI0016432 | 100 | chr10 | 57304479 | 57304559 | − | − |
| hsa-mir-3923 | MI0016430 | — | chr3 | 79507887 | 79507969 | + | − |
| hsa-mir-3922 | MI0016429 | — | chr12 | 104591633 | 104591716 | + | − |
| hsa-mir-3921 | MI0016428 | 4 | chr3 | 99964314 | 99964398 | − | − |
| hsa-mir-3920 | MI0016427 | — | chr11 | 101519820 | 101519905 | − | − |
| hsa-mir-3919 | MI0016425 | — | chr3 | 159282646 | 159282734 | + | − |

TABLE 2-continued

| miRNA ID | Accession | RPM | Chromosome | Start | End | Strand | Confidence |
|----------|-----------|-----|------------|-------|-----|--------|------------|
| hsa-mir-3918 | MI0016424 | — | chr6 | 158764661 | 158764753 | − | — |
| hsa-mir-3917 | MI0016423 | 3 | chr1 | 25906362 | 25906454 | − | — |
| hsa-mir-3916 | MI0016422 | 14 | chr1 | 247201967 | 247202060 | − | — |
| hsa-mir-3915 | MI0016420 | — | chrX | 32583656 | 32583752 | − | — |
| hsa-mir-3914-2 | MI0016421 | — | chr7 | 71307674 | 71307768 | + | — |
| hsa-mir-3914-1 | MI0016419 | — | chr7 | 71307672 | 71307770 | + | — |
| hsa-mir-3913-2 | MI0016418 | 4 | chr12 | 69584723 | 69584822 | + | — |
| hsa-mir-3913-1 | MI0016417 | 2 | chr12 | 69584722 | 69584823 | − | — |
| hsa-mir-3912 | MI0016416 | — | chr5 | 171386656 | 171386760 | − | — |
| hsa-mir-3911 | MI0016415 | 1 | chr9 | 127690687 | 127690795 | − | — |
| hsa-mir-3910-2 | MI0016431 | 2 | chr9 | 91636264 | 91636345 | − | — |
| hsa-mir-3910-1 | MI0016414 | 2 | chr9 | 91636251 | 91636361 | + | — |
| hsa-mir-3909 | MI0016413 | — | chr22 | 35335640 | 35335758 | + | ✓ |
| hsa-mir-3908 | MI0016412 | 72 | chr12 | 123536409 | 123536534 | + | — |
| hsa-mir-3907 | MI0016410 | 36 | chr7 | 151433489 | 151433639 | − | — |
| hsa-mir-384 | MI0001145 | — | chrX | 76919273 | 76919360 | − | — |
| hsa-mir-383 | MI0000791 | 8 | chr8 | 14853438 | 14853510 | − | — |
| hsa-mir-382 | MI0000790 | 23 | chr14 | 101054306 | 101054381 | + | ✓ |
| hsa-mir-381 | MI0000789 | 22 | chr14 | 101045920 | 101045994 | + | ✓ |
| hsa-mir-380 | MI0000788 | 1 | chr14 | 101025017 | 101025077 | + | ✓ |
| hsa-mir-379 | MI0000787 | 263 | chr14 | 101022066 | 101022132 | + | ✓ |
| hsa-mir-378j | MI0021273 | 7 | chr17 | 37614931 | 37615039 | − | — |
| hsa-mir-3781 | MI0016902 | 5084 | chr22 | 41923222 | 41923297 | − | — |
| hsa-mir-378h | MI0016808 | 3791 | chr5 | 154829458 | 154829540 | + | — |
| hsa-mir-378g | MI0016761 | 4642 | | | | | — |
| hsa-mir-378f | MI0016756 | 4762 | chr1 | 23929070 | 23929147 | + | — |
| hsa-mir-378e | MI0016750 | 3130 | chr5 | 170028488 | 170028566 | + | — |
| hsa-mir-378d-2 | MI0003840 | 4789 | chr8 | 93916022 | 93916119 | − | — |
| hsa-mir-378d-1 | MI0016749 | 3415 | chr4 | 5923275 | 5923328 | − | — |
| hsa-mir-378c | MI0015825 | 4978 | chr10 | 130962588 | 130962668 | − | — |
| hsa-mir-378b | MI0014154 | 3955 | chr3 | 10330229 | 10330285 | + | — |
| hsa-mir-378a | MI0000786 | 6009 | chr5 | 149732825 | 149732890 | + | ✓ |
| hsa-mir-377 | MI0000785 | 15 | chr14 | 101062050 | 101062118 | + | ✓ |
| hsa-mir-376c | MI0000776 | 214 | chr14 | 101039690 | 101039755 | + | ✓ |
| hsa-mir-376b | MI0002466 | 115 | chr14 | 101040436 | 101040535 | + | ✓ |
| hsa-mir-376a-2 | MI0003529 | 119 | chr14 | 101040069 | 101040148 | + | ✓ |
| hsa-mir-376a-1 | MI0000784 | 120 | chr14 | 101040782 | 101040849 | + | ✓ |
| hsa-mir-375 | MI0000783 | 3418 | chr2 | 219001645 | 219001708 | − | ✓ |
| hsa-mir-374c | MI0016684 | 8 | chrX | 74218549 | 74218618 | + | — |

TABLE 2-continued

| miRNA ID | Accession | RPM | Chromosome | Start | End | Strand | Confidence |
|---|---|---|---|---|---|---|---|
| hsa-mir-374b | MI0005566 | 1108 | chrX | 74218547 | 74218618 | − | ✓ |
| hsa-mir-374a | MI0000782 | 1271 | chrX | 74287286 | 74287357 | − | ✓ |
| hsa-mir-373 | MI0000781 | 2 | chr19 | 53788705 | 53788773 | + | − |
| hsa-mir-372 | MI0000780 | 91 | chr19 | 53787890 | 53787956 | + | − |
| hsa-mir-371b | MI0017393 | 23 | chr19 | 53787677 | 53787742 | − | − |
| hsa-mir-371a | MI0000779 | − | chr19 | 53787675 | 53787741 | + | − |
| hsa-mir-3714 | MI0016135 | 5 | chr3 | 16933196 | 16933260 | + | − |
| hsa-mir-3713 | MI0016134 | − | | | | | − |
| hsa-mir-370 | MI0000778 | 9 | chr14 | 100911139 | 100911213 | + | ✓ |
| hsa-mir-3692 | MI0016093 | − | chr6 | 157529132 | 157529200 | + | − |
| hsa-mir-3691 | MI0016092 | − | chr6 | 5148233 | 5148322 | − | − |
| hsa-mir-3690-2 | MI0023561 | − | chrY | 1293918 | 1293992 | + | − |
| hsa-mir-3690-1 | MI0016091 | − | chrX | 1293918 | 1293992 | + | − |
| hsa-mir-369 | MI0000777 | 53 | chr14 | 101065598 | 101065667 | + | ✓ |
| hsa-mir-3689f | MI0016837 | 25 | chr9 | 134850742 | 134850807 | − | − |
| hsa-mir-3689e | MI0016836 | − | chr9 | 134850570 | 134850641 | − | − |
| hsa-mir-3689d-2 | MI0016835 | − | chr9 | 134850277 | 134850356 | − | − |
| hsa-mir-3689d-1 | MI0016834 | − | chr9 | 134849609 | 134849682 | − | − |
| hsa-mir-3689c | MI0016832 | − | chr9 | 134849298 | 134849369 | − | − |
| hsa-mir-3689b | MI0016411 | − | chr9 | 134850125 | 134850272 | − | − |
| hsa-mir-3689a | MI0016090 | − | chr9 | 134849487 | 134849564 | − | − |
| hsa-mir-3688-2 | MI0017447 | 3 | chr4 | 159128805 | 159128891 | + | − |
| hsa-mir-3688-1 | MI0016089 | 73 | chr4 | 159128802 | 159128894 | − | − |
| hsa-mir-3686 | MI0016087 | − | chr8 | 129484057 | 129484142 | − | − |
| hsa-mir-3685 | MI0016086 | − | chr12 | 95309923 | 95309984 | + | − |
| hsa-mir-3684 | MI0016085 | − | chr4 | 98997387 | 98997460 | + | − |
| hsa-mir-3683 | MI0016084 | − | chr7 | 7066964 | 7067045 | − | − |
| hsa-mir-3682 | MI0016083 | 4 | chr2 | 53849122 | 53849205 | − | − |
| hsa-mir-3681 | MI0016082 | − | chr2 | 12199130 | 12199201 | + | − |
| hsa-mir-3680-2 | MI0019113 | 3 | chr16 | 29599179 | 29599265 | − | − |
| hsa-mir-3680-1 | MI0016081 | 3 | chr16 | 21506049 | 21506135 | − | − |
| hsa-mir-3679 | MI0016080 | − | chr2 | 134127125 | 134127192 | + | − |
| hsa-mir-3678 | MI0016079 | 10 | chr17 | 75406069 | 75406162 | + | − |
| hsa-mir-3677 | MI0016078 | 8 | chr16 | 2270713 | 2270772 | + | ✓ |
| hsa-mir-3675 | MI0016076 | − | chr1 | 16858949 | 16859021 | − | − |
| hsa-mir-3674 | MI0016075 | − | chr8 | 1801125 | 1801192 | + | − |
| hsa-mir-3672 | MI0016073 | − | chrX | 121370972 | 121371053 | + | − |
| hsa-mir-3671 | MI0016072 | − | chr1 | 65057755 | 65057842 | − | − |
| hsa-mir-3670-4 | MI0031514 | − | chr16 | 18488301 | 18488365 | − | − |

TABLE 2-continued

| miRNA ID | Accession | RPM | Chromosome | Start | End | Strand | Confidence |
|---|---|---|---|---|---|---|---|
| hsa-mir-3670-3 | MI0031513 | — | chr16 | 18405698 | 18405762 | − | — |
| hsa-mir-3670-2 | MI0019112 | — | chr16 | 16306370 | 16306434 | + | — |
| hsa-mir-3670-1 | MI0016071 | — | chr16 | 14907717 | 14907781 | + | — |
| hsa-mir-367 | MI0000775 | 9 | chr4 | 112647874 | 112647941 | − | — |
| hsa-mir-3668 | MI0016069 | — | chr6 | 140205252 | 140205326 | + | — |
| hsa-mir-3667 | MI0016068 | — | chr22 | 49543393 | 49543466 | − | — |
| hsa-mir-3666 | MI0016067 | — | chr7 | 114653345 | 114653455 | + | — |
| hsa-mir-3665 | MI0016066 | 63 | chr13 | 77698012 | 77698116 | − | — |
| hsa-mir-3664 | MI0016065 | — | chr11 | 70872270 | 70872368 | − | — |
| hsa-mir-3663 | MI0016064 | 38 | chr10 | 117167678 | 117167774 | − | — |
| hsa-mir-3662 | MI0016063 | — | chr6 | 134979338 | 134979432 | − | — |
| hsa-mir-3661 | MI0016062 | 5 | chr5 | 134225757 | 134225852 | + | — |
| hsa-mir-3660 | MI0016061 | 29 | chr5 | 90016621 | 90016720 | − | — |
| hsa-mir-365b | MI0000769 | 1025 | chr17 | 31575411 | 31575521 | + | ✓ |
| hsa-mir-365a | MI0000767 | 1023 | chr16 | 14309285 | 14309371 | + | ✓ |
| hsa-mir-3659 | MI0016060 | — | chr1 | 38089231 | 38089329 | + | — |
| hsa-mir-3658 | MI0016058 | 3 | chr1 | 165907921 | 165907976 | + | — |
| hsa-mir-3657 | MI0016057 | — | chr12 | 112037599 | 112037715 | − | ✓ |
| hsa-mir-3655 | MI0016055 | — | chr5 | 140647844 | 140647926 | + | — |
| hsa-mir-3654 | MI0016054 | — | chr7 | 133034860 | 133034915 | − | — |
| hsa-mir-3652 | MI0016052 | 5 | chr12 | 103930425 | 103930555 | + | — |
| hsa-mir-3651 | MI0016051 | 3 | chr9 | 92292458 | 92292547 | − | — |
| hsa-mir-3650 | MI0016050 | — | chr5 | 38557502 | 38557561 | − | — |
| hsa-mir-3649 | MI0016049 | 28 | chr12 | 1660315 | 1660380 | − | — |
| hsa-mir-3648-2 | MI0031512 | 8 | chr21 | 8986999 | 8987178 | + | — |
| hsa-mir-3648-1 | MI0016048 | 8 | chr21 | 8208473 | 8208652 | + | — |
| hsa-mir-3646 | MI0016046 | 18 | chr20 | 44408120 | 44408203 | + | — |
| hsa-mir-363 | MI0000764 | 757 | chrX | 134169378 | 134169452 | − | ✓ |
| hsa-mir-3622b | MI0016014 | 6 | chr8 | 27701673 | 27701767 | − | — |
| hsa-mir-3622a | MI0016013 | 5 | chr8 | 27701677 | 27701759 | + | — |
| hsa-mir-3621 | MI0016012 | — | chr9 | 137169186 | 137169270 | − | — |
| hsa-mir-3620 | MI0016011 | — | chr1 | 228097263 | 228097341 | + | — |
| hsa-mir-362 | MI0000762 | 61 | chrX | 50008964 | 50009028 | + | ✓ |
| hsa-mir-3619 | MI0016009 | 2 | chr22 | 46091044 | 46091126 | + | — |
| hsa-mir-3618 | MI0016008 | 8 | chr22 | 20085746 | 20085833 | + | — |
| hsa-mir-3617 | MI0016007 | — | chr20 | 45705102 | 45705180 | − | — |
| hsa-mir-3616 | MI0016006 | 2 | chr20 | 47166967 | 47167058 | + | ✓ |
| hsa-mir-3615 | MI0016005 | 11 | chr17 | 74748613 | 74748699 | + | — |
| hsa-mir-3614 | MI0016004 | 19 | chr17 | 56891270 | 56891355 | − | ✓ |

TABLE 2-continued

| miRNA ID | Accession | RPM | Chromosome | Start | End | Strand | Confidence |
|---|---|---|---|---|---|---|---|
| hsa-mir-3613 | MI0016003 | 321 | chr13 | 49996415 | 49996501 | − | ✓ |
| hsa-mir-3612 | MI0016002 | — | chr12 | 128294092 | 128294178 | + | — |
| hsa-mir-3611 | MI0016001 | 4 | chr10 | 35079598 | 35079680 | − | ✓ |
| hsa-mir-3610 | MI0016000 | 13 | chr8 | 116874728 | 116874800 | − | — |
| hsa-mir-361 | MI0000760 | 866 | chrX | 85903636 | 85903707 | − | ✓ |
| hsa-mir-3609 | MI0015999 | 73 | chr7 | 98881650 | 98881729 | + | — |
| hsa-mir-3606 | MI0015996 | 9 | chr2 | 188995630 | 188995692 | + | — |
| hsa-mir-3605 | MI0015995 | 1 | chr1 | 33332393 | 33332492 | − | — |
| hsa-mir-3529 | MI0017351 | — | chr15 | 88611847 | 88611924 | − | — |
| hsa-mir-34c | MI0000743 | 379 | chr11 | 111513439 | 111513515 | + | ✓ |
| hsa-mir-34b | MI0000742 | 43 | chr11 | 111512938 | 111513021 | + | ✓ |
| hsa-mir-34a | MI0000268 | 269 | chr1 | 9151668 | 9151777 | − | ✓ |
| hsa-mir-346 | MI0000826 | 3 | chr10 | 86264694 | 86264788 | − | — |
| hsa-mir-345 | MI0000825 | 123 | chr14 | 100307859 | 100307956 | + | ✓ |
| hsa-mir-342 | MI0000805 | 776 | chr14 | 100109655 | 100109753 | + | ✓ |
| hsa-mir-340 | MI0000802 | 913 | chr5 | 180015303 | 180015397 | − | ✓ |
| hsa-mir-33b | MI0003646 | 27 | chr17 | 17813836 | 17813931 | − | ✓ |
| hsa-mir-33a | MI0000091 | 256 | chr22 | 41900944 | 41901012 | + | ✓ |
| hsa-mir-339 | MI0000815 | 238 | chr7 | 1022933 | 1023026 | − | ✓ |
| hsa-mir-338 | MI0000814 | 97 | chr17 | 81125883 | 81125949 | − | ✓ |
| hsa-mir-337 | MI0000806 | 21 | chr14 | 100874493 | 100874585 | + | ✓ |
| hsa-mir-335 | MI0000816 | 3777 | chr7 | 130496111 | 130496204 | + | ✓ |
| hsa-mir-331 | MI0000812 | 226 | chr12 | 95308420 | 95308513 | + | — |
| hsa-mir-330 | MI0000803 | 70 | chr19 | 45638994 | 45639087 | − | ✓ |
| hsa-mir-329-2 | MI0001726 | — | chr14 | 101027100 | 101027183 | + | ✓ |
| hsa-mir-329-1 | MI0001725 | — | chr14 | 101026785 | 101026864 | + | ✓ |
| hsa-mir-328 | MI0000804 | 31 | chr16 | 67202321 | 67202395 | − | — |
| hsa-mir-326 | MI0000808 | 14 | chr11 | 75335092 | 75335186 | − | — |
| hsa-mir-325 | MI0000824 | — | chrX | 77005404 | 77005501 | − | — |
| hsa-mir-324 | MI0000813 | 210 | chr17 | 7223297 | 7223379 | − | ✓ |
| hsa-mir-323b | MI0014206 | — | chr14 | 101056219 | 101056300 | + | — |
| hsa-mir-323a | MI0000807 | 1 | chr14 | 101025732 | 101025817 | + | ✓ |
| hsa-mir-320e | MI0014234 | 4717 | chr19 | 46709282 | 46709354 | − | — |
| hsa-mir-320d-2 | MI0008192 | 2985 | chrX | 140926160 | 140926231 | − | — |
| hsa-mir-320d-1 | MI0008190 | 4526 | chr13 | 40727816 | 40727887 | − | — |
| hsa-mir-320c-2 | MI0008191 | 4285 | chr18 | 24321675 | 24321746 | + | — |
| hsa-mir-320c-1 | MI0003778 | 3570 | chr18 | 21683518 | 21683589 | + | — |
| hsa-mir-320b-2 | MI0003839 | 5249 | chr1 | 224257040 | 224257110 | − | — |
| hsa-mir-320b-1 | MI0003776 | 5177 | chr1 | 116671746 | 116671817 | + | — |

TABLE 2-continued

| miRNA ID | Accession | RPM | Chromosome | Start | End | Strand | Confidence |
|---|---|---|---|---|---|---|---|
| hsa-mir-320a | MI0000542 | 5331 | chr8 | 22244966 | 22245037 | − | ✓ |
| hsa-mir-3202-2 | MI0014253 | 3 | chrX | 153981098 | 153981176 | − | — |
| hsa-mir-3202-1 | MI0014252 | 1 | chrX | 153981097 | 153981177 | + | — |
| hsa-mir-3201 | MI0014250 | — | chr22 | 48274364 | 48274415 | + | — |
| hsa-mir-3200 | MI0014249 | 3 | chr22 | 30731557 | 30731641 | + | ✓ |
| hsa-mir-32 | MI0000090 | 222 | chr9 | 109046229 | 109046298 | − | ✓ |
| hsa-mir-3199-2 | MI0014248 | — | chr22 | 27920526 | 27920611 | + | — |
| hsa-mir-3199-1 | MI0014247 | — | chr22 | 27920525 | 27920612 | − | — |
| hsa-mir-3198-2 | MI0017335 | — | chr12 | 54231397 | 54231476 | − | — |
| hsa-mir-3198-1 | MI0014246 | — | chr22 | 17764180 | 17764259 | − | — |
| hsa-mir-3197 | MI0014245 | — | chr21 | 41167557 | 41167629 | + | — |
| hsa-mir-3196 | MI0014241 | 12 | chr20 | 63238779 | 63238842 | + | — |
| hsa-mir-3195 | MI0014240 | 27 | chr20 | 62064802 | 62064885 | + | — |
| hsa-mir-3194 | MI0014239 | — | chr20 | 51452905 | 51452977 | − | — |
| hsa-mir-3193 | MI0014238 | — | chr20 | 31607186 | 31607240 | + | — |
| hsa-mir-3192 | MI0014237 | 457 | chr20 | 18470615 | 18470691 | + | — |
| hsa-mir-3191 | MI0014236 | — | chr19 | 47226944 | 47227019 | − | — |
| hsa-mir-3190 | MI0014235 | 12 | chr19 | 47226942 | 47227021 | + | — |
| hsa-mir-3189 | MI0014233 | 2 | chr19 | 18386562 | 18386634 | + | — |
| hsa-mir-3188 | MI0014232 | 1 | chr19 | 18282077 | 18282161 | + | — |
| hsa-mir-3187 | MI0014231 | 2 | chr19 | 813584 | 813653 | + | — |
| hsa-mir-3186 | MI0014229 | — | chr17 | 81451104 | 81451188 | − | — |
| hsa-mir-3185 | MI0014227 | 6 | chr17 | 48724408 | 48724475 | − | — |
| hsa-mir-3184 | MI0014226 | — | chr17 | 30117086 | 30117160 | − | — |
| hsa-mir-3183 | MI0014225 | — | chr17 | 1022476 | 1022559 | − | — |
| hsa-mir-3182 | MI0014224 | 37 | chr16 | 83508346 | 83508408 | + | — |
| hsa-mir-3181 | MI0014223 | 10 | chr16 | 50742305 | 50742377 | + | — |
| hsa-mir-3180-5 | MI0016409 | 15 | chr16 | 2135977 | 2136129 | − | — |
| hsa-mir-3180-4 | MI0016408 | 14 | chr16 | 15154850 | 15155002 | − | — |
| hsa-mir-3180-3 | MI0014217 | 13 | chr16 | 18402178 | 18402271 | − | ✓ |
| hsa-mir-3180-2 | MI0014215 | 13 | chr16 | 16309879 | 16309966 | + | ✓ |
| hsa-mir-3180-1 | MI0014214 | 13 | chr16 | 14911220 | 14911313 | + | ✓ |
| hsa-mir-3179-4 | MI0031510 | — | chr16 | 18494493 | 18494576 | − | — |
| hsa-mir-3179-3 | MI0014221 | — | chr16 | 18411894 | 18411977 | − | — |
| hsa-mir-3179-2 | MI0014216 | — | chr16 | 16300159 | 16300242 | + | — |
| hsa-mir-3179-1 | MI0014213 | — | chr16 | 14901508 | 14901591 | + | — |
| hsa-mir-3178 | MI0014212 | 37 | chr16 | 2531922 | 2532005 | − | — |
| hsa-mir-3177 | MI0014211 | — | chr16 | 1734985 | 1735066 | + | — |
| hsa-mir-3176 | MI0014210 | 51 | chr16 | 543277 | 543366 | + | — |

TABLE 2-continued

| miRNA ID | Accession | RPM | Chromosome | Start | End | Strand | Confidence |
|----------|-----------|-----|------------|-------|-----|--------|------------|
| hsa-mir-3175 | MI0014209 | 1 | chr15 | 92904399 | 92904475 | + | — |
| hsa-mir-3174 | MI0014208 | — | chr15 | 90006755 | 90006841 | + | — |
| hsa-mir-3173 | MI0014204 | 7 | chr14 | 95137919 | 95137986 | − | ✓ |
| hsa-mir-3171 | MI0014202 | — | chr14 | 27633205 | 27633278 | − | ✓ |
| hsa-mir-3170 | MI0014201 | — | chr13 | 98208524 | 98208600 | + | — |
| hsa-mir-3169 | MI0014200 | — | chr13 | 61199798 | 61199880 | − | — |
| hsa-mir-3168 | MI0014199 | 98 | chr13 | 41101019 | 41101100 | − | — |
| hsa-mir-3167 | MI0014198 | — | chr11 | 126988458 | 126988542 | − | — |
| hsa-mir-3166 | MI0014196 | — | chr11 | 88176502 | 88176593 | + | — |
| hsa-mir-3165 | MI0014195 | 1 | chr11 | 72072228 | 72072302 | − | — |
| hsa-mir-3164 | MI0014194 | — | chr11 | 69083176 | 69083258 | + | — |
| hsa-mir-3163 | MI0014193 | 4 | chr11 | 66934434 | 66934506 | − | — |
| hsa-mir-3162 | MI0014192 | 1 | chr11 | 59595077 | 59595158 | − | — |
| hsa-mir-3161 | MI0014191 | — | chr11 | 48096782 | 48096858 | + | — |
| hsa-mir-3160-2 | MI0014190 | 1 | chr11 | 46451807 | 46451887 | + | — |
| hsa-mir-3160-1 | MI0014189 | — | chr11 | 46451805 | 46451889 | − | — |
| hsa-mir-3159 | MI0014188 | 638 | chr11 | 18387787 | 18387860 | + | — |
| hsa-mir-3158-2 | MI0014187 | 2 | chr10 | 101601417 | 101601497 | − | ✓ |
| hsa-mir-3158-1 | MI0014186 | 2 | chr10 | 101601417 | 101601497 | + | ✓ |
| hsa-mir-3157 | MI0014185 | — | chr10 | 96064315 | 96064399 | − | ✓ |
| hsa-mir-3156-3 | MI0014242 | — | chr21 | 13406384 | 13406460 | − | — |
| hsa-mir-3156-2 | MI0014230 | — | chr18 | 14830166 | 14830242 | + | — |
| hsa-mir-3156-1 | MI0014184 | — | chr10 | 45164014 | 45164088 | + | — |
| hsa-mir-3155b | MI0016839 | 22 | chr10 | 6152207 | 6152262 | − | — |
| hsa-mir-3155a | MI0014183 | 2 | chr10 | 6152196 | 6152277 | + | ✓ |
| hsa-mir-3154 | MI0014182 | 1 | chr9 | 128244947 | 128245030 | − | — |
| hsa-mir-3153 | MI0014180 | — | chr9 | 89312225 | 89312306 | + | — |
| hsa-mir-3152 | MI0014179 | 19 | chr9 | 18573306 | 18573379 | + | — |
| hsa-mir-3151 | MI0014178 | — | chr8 | 103154614 | 103154689 | + | — |
| hsa-mir-3150b | MI0016426 | 5 | chr8 | 95072911 | 95072996 | − | — |
| hsa-mir-3150a | MI0014177 | 24 | chr8 | 95072914 | 95072993 | + | — |
| hsa-mir-3149 | MI0014176 | 130 | chr8 | 76966768 | 76966850 | − | — |
| hsa-mir-3148 | MI0014175 | — | chr8 | 29957272 | 29957348 | − | — |
| hsa-mir-3147 | MI0014173 | — | chr7 | 57405025 | 57405090 | + | — |
| hsa-mir-3146 | MI0014172 | — | chr7 | 19705358 | 19705436 | − | — |
| hsa-mir-3145 | MI0014170 | — | chr6 | 138435213 | 138435294 | − | — |
| hsa-mir-3144 | MI0014169 | 3 | chr6 | 120015179 | 120015257 | + | ✓ |
| hsa-mir-3143 | MI0014167 | 172 | chr6 | 27147626 | 27147688 | + | — |
| hsa-mir-3142 | MI0014166 | — | chr5 | 160474402 | 160474483 | + | — |

TABLE 2-continued

| miRNA ID | Accession | RPM | Chromosome | Start | End | Strand | Confidence |
|---|---|---|---|---|---|---|---|
| hsa-mir-3141 | MI0014165 | 1 | chr5 | 154596012 | 154596072 | – | – |
| hsa-mir-3140 | MI0014163 | – | chr4 | 152489327 | 152489416 | – | ✓ |
| hsa-mir-3139 | MI0014162 | 48 | chr4 | 143343460 | 143343535 | + | – |
| hsa-mir-3138 | MI0014161 | 1 | chr4 | 10078611 | 10078692 | – | – |
| hsa-mir-3137 | MI0014160 | 28 | chr3 | 195134506 | 195134580 | – | – |
| hsa-mir-3136 | MI0014158 | – | chr3 | 69048958 | 69049035 | – | – |
| hsa-mir-3135b | MI0016809 | 71 | chr6 | 32749912 | 32749979 | – | – |
| hsa-mir-3135a | MI0014156 | 367 | chr3 | 20137565 | 20137641 | + | – |
| hsa-mir-3134 | MI0014155 | 14 | chr3 | 15697298 | 15697371 | – | – |
| hsa-mir-3133 | MI0014153 | – | chr2 | 241477905 | 241477982 | + | – |
| hsa-mir-3132 | MI0014152 | – | chr2 | 219549073 | 219549147 | – | – |
| hsa-mir-3131 | MI0014151 | – | chr2 | 219058688 | 219058750 | – | – |
| hsa-mir-3130-2 | MI0014148 | 3 | chr2 | 206783234 | 206783308 | + | ✓ |
| hsa-mir-3130-1 | MI0014147 | 3 | chr2 | 206783234 | 206783308 | – | ✓ |
| hsa-mir-3129 | MI0014146 | – | chr2 | 189133036 | 189133111 | – | – |
| hsa-mir-3128 | MI0014145 | – | chr2 | 177255945 | 177256010 | – | – |
| hsa-mir-3127 | MI0014144 | – | chr2 | 96798278 | 96798353 | + | – |
| hsa-mir-3126 | MI0014143 | – | chr2 | 69103682 | 69103755 | + | ✓ |
| hsa-mir-3125 | MI0014142 | 9 | chr2 | 12737367 | 12737444 | + | – |
| hsa-mir-3124 | MI0014140 | – | chr1 | 248826377 | 248826443 | + | – |
| hsa-mir-3123 | MI0014139 | 46 | chr1 | 241132272 | 241132346 | + | – |
| hsa-mir-3122 | MI0014138 | – | chr1 | 212077613 | 212077685 | + | – |
| hsa-mir-3121 | MI0014137 | – | chr1 | 180438314 | 180438390 | – | – |
| hsa-mir-3120 | MI0014136 | – | chr1 | 172138808 | 172138888 | + | – |
| hsa-mir-3119-2 | MI0014135 | – | chr1 | 170151378 | 170151462 | + | – |
| hsa-mir-3119-1 | MI0014134 | – | chr1 | 170151378 | 170151462 | – | – |
| hsa-mir-3118-4 | MI0014207 | – | chr15 | 21843750 | 21843824 | + | – |
| hsa-mir-3118-3 | MI0014133 | – | chr15 | 21406385 | 21406459 | + | – |
| hsa-mir-3118-2 | MI0014132 | – | chr15 | 20832795 | 20832869 | + | – |
| hsa-mir-3118-1 | MI0014131 | – | chr21 | 13644775 | 13644850 | – | – |
| hsa-mir-3117 | MI0014130 | – | chr1 | 66628440 | 66628517 | + | – |
| hsa-mir-3116-2 | MI0014129 | – | chr1 | 62078789 | 62078856 | – | – |
| hsa-mir-3116-1 | MI0014128 | – | chr1 | 62078786 | 62078859 | + | – |
| hsa-mir-3115 | MI0014127 | 29 | chr1 | 23044305 | 23044372 | + | – |
| hsa-mir-31 | MI0000089 | 1263 | chr9 | 21512115 | 21512185 | – | ✓ |
| hsa-mir-30e | MI0000749 | 10738 | chr1 | 40754355 | 40754446 | + | ✓ |
| hsa-mir-30d | MI0000255 | 11691 | chr8 | 134804876 | 134804945 | – | ✓ |
| hsa-mir-30c-2 | MI0000254 | 3223 | chr6 | 71376960 | 71377031 | – | ✓ |
| hsa-mir-30c-1 | MI0000736 | 3205 | chr1 | 40757284 | 40757372 | + | ✓ |

TABLE 2-continued

| miRNA ID | Accession | RPM | Chromosome | Start | End | Strand | Confidence |
|----------|-----------|-----|------------|-------|-----|--------|------------|
| hsa-mir-30b | MI0000441 | 2245 | chr8 | 134800520 | 134800607 | – | ✓ |
| hsa-mir-30a | MI0000088 | 15057 | chr6 | 71403551 | 71403621 | – | ✓ |
| hsa-mir-3085 | MI0039500 | – | chr10 | 97875813 | 97875897 | – | – |
| hsa-mir-3074 | MI0014181 | 4 | chr9 | 95086014 | 95086094 | – | – |
| hsa-mir-3065 | MI0014228 | 39 | chr17 | 81125877 | 81125955 | + | ✓ |
| hsa-mir-3064 | MI0017375 | – | chr17 | 64500774 | 64500839 | – | – |
| hsa-mir-3059 | MI0039499 | 8 | chr12 | 86745068 | 86745149 | – | ✓ |
| hsa-mir-302f | MI0006418 | – | chr18 | 30298910 | 30298960 | + | – |
| hsa-mir-302e | MI0006417 | – | chr11 | 7234766 | 7234837 | + | – |
| hsa-mir-302d | MI0000774 | 10 | chr4 | 112648004 | 112648071 | – | – |
| hsa-mir-302c | MI0000773 | – | chr4 | 112648363 | 112648430 | – | – |
| hsa-mir-302b | MI0000772 | – | chr4 | 112648485 | 112648557 | – | – |
| hsa-mir-302a | MI0000738 | 42 | chr4 | 112648183 | 112648251 | – | ✓ |
| hsa-mir-301b | MI0005568 | 140 | chr22 | 21652981 | 21653058 | + | ✓ |
| hsa-mir-301a | MI0000745 | 227 | chr17 | 59151136 | 59151221 | – | ✓ |
| hsa-mir-300 | MI0005525 | – | chr14 | 101041363 | 101041445 | + | – |
| hsa-mir-29c | MI0000735 | 11179 | chr1 | 207801852 | 207801939 | – | ✓ |
| hsa-mir-29b-2 | MI0000107 | 8561 | chr1 | 207802443 | 207802523 | – | ✓ |
| hsa-mir-29b-1 | MI0000105 | 8558 | chr7 | 130877459 | 130877539 | – | ✓ |
| hsa-mir-29a | MI0000087 | 11796 | chr7 | 130876747 | 130876810 | – | ✓ |
| hsa-mir-299 | MI0000744 | 14 | chr14 | 101023794 | 101023856 | + | ✓ |
| hsa-mir-298 | MI0005523 | – | chr20 | 58818226 | 58818313 | – | – |
| hsa-mir-297 | MI0005775 | 3 | chr4 | 110860582 | 110860647 | – | – |
| hsa-mir-296 | MI0000747 | 12 | chr20 | 58817615 | 58817694 | – | ✓ |
| hsa-mir-2909 | MI0013083 | – | chr17 | 37033745 | 37033813 | + | – |
| hsa-mir-2861 | MI0013006 | 9 | chr9 | 127785918 | 127786007 | + | – |
| hsa-mir-28 | MI0000086 | 3607 | chr3 | 188688781 | 188688866 | + | ✓ |
| hsa-mir-27b | MI0000440 | 14864 | chr9 | 95085445 | 95085541 | + | ✓ |
| hsa-mir-27a | MI0000085 | 8588 | chr19 | 13836440 | 13836517 | – | ✓ |
| hsa-mir-26b | MI0000084 | 17403 | chr2 | 218402646 | 218402722 | + | ✓ |
| hsa-mir-26a-2 | MI0000750 | 36460 | chr12 | 57824609 | 57824692 | – | ✓ |
| hsa-mir-26a-1 | MI0000083 | 26870 | chr3 | 37969404 | 37969480 | + | ✓ |
| hsa-mir-2682 | MI0012063 | – | chr1 | 98045242 | 98045351 | – | – |
| hsa-mir-2681 | MI0012062 | – | chr13 | 101967642 | 101967746 | – | – |
| hsa-mir-25 | MI0000082 | 3122 | chr7 | 100093560 | 100093643 | – | ✓ |
| hsa-mir-2467 | MI0017432 | – | chr2 | 239351724 | 239351804 | – | ✓ |
| hsa-mir-24-2 | MI0000081 | 3749 | chr19 | 13836287 | 13836359 | – | ✓ |
| hsa-mir-24-1 | MI0000080 | 3719 | chr9 | 95086021 | 95086088 | + | ✓ |
| hsa-mir-23c | MI0016010 | 5962 | chrX | 20017088 | 20017187 | – | – |

TABLE 2-continued

| miRNA ID | Accession | RPM | Chromosome | Start | End | Strand | Confidence |
|---|---|---|---|---|---|---|---|
| hsa-mir-23b | MI0000439 | 11091 | chr9 | 95085208 | 95085304 | + | — |
| hsa-mir-23a | MI0000079 | 10137 | chr19 | 13836587 | 13836659 | − | ✓ |
| hsa-mir-2392 | MI0016870 | — | chr14 | 100814491 | 100814574 | + | — |
| hsa-mir-2355 | MI0015873 | 10 | chr2 | 207109987 | 207110073 | − | — |
| hsa-mir-2278 | MI0011285 | 3 | chr9 | 94809962 | 94810057 | + | — |
| hsa-mir-2277 | MI0011284 | — | chr5 | 93620696 | 93620788 | − | ✓ |
| hsa-mir-2276 | MI0011282 | — | chr13 | 24162416 | 24162504 | + | ✓ |
| hsa-mir-224 | MI0000301 | 237 | chrX | 151958578 | 151958658 | − | ✓ |
| hsa-mir-223 | MI0000300 | 1044 | chrX | 66018870 | 66018979 | + | ✓ |
| hsa-mir-222 | MI0000299 | 3517 | chrX | 45747015 | 45747124 | − | ✓ |
| hsa-mir-221 | MI0000298 | 4317 | chrX | 45746157 | 45746266 | − | ✓ |
| hsa-mir-22 | MI0000078 | 3830 | chr17 | 1713903 | 1713987 | − | ✓ |
| hsa-mir-219b | MI0017299 | — | chr9 | 128392621 | 128392708 | + | ✓ |
| hsa-mir-219a-2 | MI0000740 | 141 | chr9 | 128392618 | 128392714 | − | ✓ |
| hsa-mir-219a-1 | MI0000296 | — | chr6 | 33207835 | 33207944 | + | ✓ |
| hsa-mir-218-2 | MI0000295 | 1077 | chr5 | 168768146 | 168768255 | − | ✓ |
| hsa-mir-218-1 | MI0000294 | 1151 | chr4 | 20528275 | 20528384 | + | ✓ |
| hsa-mir-217 | MI0000293 | 120 | chr2 | 55982967 | 55983076 | − | — |
| hsa-mir-216b | MI0005569 | 5 | chr2 | 56000714 | 56000795 | − | — |
| hsa-mir-216a | MI0000292 | 413 | chr2 | 55988950 | 55989059 | − | ✓ |
| hsa-mir-215 | MI0000291 | 686 | chr1 | 220117853 | 220117962 | − | — |
| hsa-mir-214 | MI0000290 | 459 | chr1 | 172138798 | 172138907 | − | ✓ |
| hsa-mir-212 | MI0000288 | 28 | chr17 | 2050271 | 2050380 | − | ✓ |
| hsa-mir-2117 | MI0010636 | — | chr17 | 43444806 | 43444885 | + | — |
| hsa-mir-2116 | MI0010635 | — | chr15 | 59171183 | 59171262 | − | ✓ |
| hsa-mir-2115 | MI0010634 | 1 | chr3 | 48316360 | 48316459 | − | ✓ |
| hsa-mir-2114 | MI0010633 | — | chrX | 150228004 | 150228083 | + | ✓ |
| hsa-mir-2113 | MI0003939 | 8 | chr6 | 98024531 | 98024621 | + | — |
| hsa-mir-2110 | MI0010629 | 11 | chr10 | 114174105 | 114174179 | − | ✓ |
| hsa-mir-211 | MI0000287 | 500 | chr15 | 31065032 | 31065141 | − | ✓ |
| hsa-mir-210 | MI0000286 | 160 | chr11 | 568089 | 568198 | − | ✓ |
| hsa-mir-21 | MI0000077 | 99440 | chr17 | 59841266 | 59841337 | + | ✓ |
| hsa-mir-20b | MI0001519 | 544 | chrX | 134169809 | 134169877 | − | ✓ |
| hsa-mir-20a | MI0000076 | 7477 | chr13 | 91351065 | 91351135 | + | ✓ |
| hsa-mir-208b | MI0005570 | 49 | chr14 | 23417987 | 23418063 | − | ✓ |
| hsa-mir-208a | MI0000251 | 90 | chr14 | 23388596 | 23388666 | − | ✓ |
| hsa-mir-206 | MI0000490 | 375 | chr6 | 52144349 | 52144434 | + | — |
| hsa-mir-2054 | MI0010488 | — | chr4 | 125507259 | 125507307 | + | — |
| hsa-mir-2053 | MI0010487 | — | chr8 | 112643493 | 112643583 | + | — |

TABLE 2-continued

| miRNA ID | Accession | RPM | Chromosome | Start | End | Strand | Confidence |
|---|---|---|---|---|---|---|---|
| hsa-mir-2052 | MI0010486 | — | chr8 | 74705693 | 74705747 | + | — |
| hsa-mir-205 | MI0000285 | 6213 | chr1 | 209432133 | 209432242 | + | ✓ |
| hsa-mir-204 | MI0000284 | 400 | chr9 | 70809975 | 70810084 | − | ✓ |
| hsa-mir-203b | MI0017343 | — | chr14 | 104117418 | 104117503 | − | — |
| hsa-mir-203a | MI0000283 | 524 | chr14 | 104117405 | 104117514 | + | ✓ |
| hsa-mir-202 | MI0003130 | 190 | chr10 | 133247511 | 133247620 | − | ✓ |
| hsa-mir-200c | MI0000650 | 4878 | chr12 | 6963699 | 6963766 | + | ✓ |
| hsa-mir-200b | MI0000342 | 3832 | chr1 | 1167104 | 1167198 | + | ✓ |
| hsa-mir-200a | MI0000737 | 2312 | chr1 | 1167863 | 1167952 | + | ✓ |
| hsa-mir-19b-2 | MI0000075 | 11771 | chrX | 134169671 | 134169766 | − | ✓ |
| hsa-mir-19b-1 | MI0000074 | 11311 | chr13 | 91351192 | 91351278 | + | ✓ |
| hsa-mir-19a | MI0000073 | 10618 | chr13 | 91350891 | 91350972 | + | ✓ |
| hsa-mir-199b | MI0000282 | 9394 | chr9 | 128244721 | 128244830 | − | ✓ |
| hsa-mir-199a-2 | MI0000281 | 10237 | chr1 | 172144535 | 172144644 | − | ✓ |
| hsa-mir-199a-1 | MI0000242 | 10013 | chr19 | 10817426 | 10817496 | − | ✓ |
| hsa-mir-198 | MI0000240 | 7 | chr3 | 120395668 | 120395729 | − | — |
| hsa-mir-1976 | MI0009986 | 1 | chr1 | 26554542 | 26554593 | + | — |
| hsa-mir-1973 | MI0009983 | 5 | | | | | — |
| hsa-mir-1972-2 | MI0015977 | 94 | chr16 | 70030346 | 70030422 | + | — |
| hsa-mir-1972-1 | MI0009982 | 94 | chr16 | 15010321 | 15010397 | − | — |
| hsa-mir-197 | MI0000239 | 195 | chr1 | 109598893 | 109598967 | + | ✓ |
| hsa-mir-196b | MI0001150 | 1662 | chr7 | 27169480 | 27169563 | − | ✓ |
| hsa-mir-196a-2 | MI0000279 | 1231 | chr12 | 53991738 | 53991847 | + | ✓ |
| hsa-mir-196a-1 | MI0000238 | 1430 | chr17 | 48632490 | 48632559 | − | ✓ |
| hsa-mir-195 | MI0000489 | 2034 | chr17 | 7017615 | 7017701 | − | ✓ |
| hsa-mir-194-2 | MI0000732 | 155 | chr11 | 64891355 | 64891439 | − | ✓ |
| hsa-mir-194-1 | MI0000488 | 167 | chr1 | 220118157 | 220118241 | − | — |
| hsa-mir-193b | MI0003137 | 657 | chr16 | 14303967 | 14304049 | + | ✓ |
| hsa-mir-193a | MI0000487 | 540 | chr17 | 31559996 | 31560083 | + | ✓ |
| hsa-mir-192 | MI0000234 | 781 | chr11 | 64891137 | 64891246 | − | ✓ |
| hsa-mir-1915 | MI0008336 | 3 | chr10 | 21496562 | 21496641 | − | — |
| hsa-mir-1914 | MI0008335 | — | chr20 | 63941465 | 63941544 | − | — |
| hsa-mir-1913 | MI0008334 | 2 | chr6 | 166509354 | 166509433 | − | — |
| hsa-mir-1912 | MI0008333 | 8 | chrX | 114651544 | 114651623 | + | ✓ |
| hsa-mir-1911 | MI0008332 | — | chrX | 114763184 | 114763263 | + | — |
| hsa-mir-1910 | MI0008331 | 5 | chr16 | 85741621 | 85741700 | − | — |
| hsa-mir-191 | MI0000465 | 8868 | chr3 | 49020618 | 49020709 | − | ✓ |
| hsa-mir-190b | MI0005545 | 8 | chr1 | 154193665 | 154193743 | − | — |
| hsa-mir-190a | MI0000486 | 15 | chr15 | 62823957 | 62824041 | + | ✓ |

TABLE 2-continued

| miRNA ID | Accession | RPM | Chromosome | Start | End | Strand | Confidence |
|---|---|---|---|---|---|---|---|
| hsa-mir-1909 | MI0008330 | 2 | chr19 | 1816159 | 1816238 | – | — |
| hsa-mir-1908 | MI0008329 | 20 | chr11 | 61815161 | 61815240 | – | — |
| hsa-mir-18b | MI0001518 | 2965 | chrX | 134170041 | 134170111 | – | ✓ |
| hsa-mir-18a | MI0000072 | 3057 | chr13 | 91350751 | 91350821 | + | ✓ |
| hsa-mir-188 | MI0000484 | 28 | chrX | 50003503 | 50003588 | + | ✓ |
| hsa-mir-187 | MI0000274 | 111 | chr18 | 35904818 | 35904926 | – | ✓ |
| hsa-mir-186 | MI0000483 | 4207 | chr1 | 71067631 | 71067716 | – | ✓ |
| hsa-mir-185 | MI0000482 | 1871 | chr22 | 20033139 | 20033220 | + | ✓ |
| hsa-mir-1843 | MI0032314 | 7 | chr1 | 175968370 | 175968479 | – | — |
| hsa-mir-184 | MI0000481 | 127 | chr15 | 79209788 | 79209871 | + | ✓ |
| hsa-mir-183 | MI0000273 | 490 | chr7 | 129774905 | 129775014 | – | ✓ |
| hsa-mir-1827 | MI0008195 | 29 | chr12 | 100189884 | 100189949 | + | — |
| hsa-mir-1825 | MI0008193 | — | chr20 | 32237795 | 32237847 | + | — |
| hsa-mir-182 | MI0000272 | 1322 | chr7 | 129770383 | 129770492 | – | ✓ |
| hsa-mir-181d | MI0003139 | 896 | chr19 | 13874875 | 13875011 | + | ✓ |
| hsa-mir-181c | MI0000271 | 180 | chr19 | 13874699 | 13874808 | + | ✓ |
| hsa-mir-181b-2 | MI0000683 | 894 | chr9 | 124693710 | 124693798 | + | ✓ |
| hsa-mir-181b-1 | MI0000270 | 893 | chr1 | 198858873 | 198858982 | – | ✓ |
| hsa-mir-181a-2 | MI0000269 | 3589 | chr9 | 124692442 | 124692551 | + | ✓ |
| hsa-mir-181a-1 | MI0000289 | 3606 | chr1 | 198859044 | 198859153 | – | ✓ |
| hsa-mir-17 | MI0000071 | 9521 | chr13 | 91350605 | 91350688 | + | ✓ |
| hsa-mir-16-2 | MI0000115 | 10438 | chr3 | 160404745 | 160404825 | + | ✓ |
| hsa-mir-16-1 | MI0000070 | 10589 | chr13 | 50048973 | 50049061 | – | ✓ |
| hsa-mir-15b | MI0000438 | 6198 | chr3 | 160404588 | 160404685 | + | ✓ |
| hsa-mir-15a | MI0000069 | 4045 | chr13 | 50049119 | 50049201 | – | ✓ |
| hsa-mir-1587 | MI0016905 | — | chrX | 39837561 | 39837613 | + | — |
| hsa-mir-155 | MI0000681 | 355 | chr21 | 25573980 | 25574044 | + | ✓ |
| hsa-mir-154 | MI0000480 | 2 | chr14 | 101059755 | 101059838 | + | ✓ |
| hsa-mir-1539 | MI0007260 | — | chr18 | 49487373 | 49487422 | + | — |
| hsa-mir-1538 | MI0007259 | — | chr16 | 69565808 | 69565868 | – | — |
| hsa-mir-1537 | MI0007258 | 2 | chr1 | 235853000 | 235853060 | – | — |
| hsa-mir-153-2 | MI0000464 | 75 | chr7 | 157574336 | 157574422 | – | ✓ |
| hsa-mir-153-1 | MI0000463 | 69 | chr2 | 219294111 | 219294200 | – | ✓ |
| hsa-mir-152 | MI0000462 | 2307 | chr17 | 48037161 | 48037247 | – | ✓ |
| hsa-mir-151b | MI0003772 | 2711 | chr14 | 100109419 | 100109514 | – | — |
| hsa-mir-151a | MI0000809 | 4889 | chr8 | 140732564 | 140732653 | – | — |
| hsa-mir-150 | MI0000479 | 699 | chr19 | 49500785 | 49500868 | – | ✓ |
| hsa-mir-149 | MI0000478 | 130 | chr2 | 240456001 | 240456089 | + | ✓ |
| hsa-mir-148b | MI0000811 | 2746 | chr12 | 54337216 | 54337314 | + | ✓ |

TABLE 2-continued

| miRNA ID | Accession | RPM | Chromosome | Start | End | Strand | Confidence |
|---|---|---|---|---|---|---|---|
| hsa-mir-148a | MI0000253 | 15136 | chr7 | 25949919 | 25949986 | − | ✓ |
| hsa-mir-147b | MI0005544 | 32 | chr15 | 45433050 | 45433129 | + | ✓ |
| hsa-mir-147a | MI0000262 | 44 | chr9 | 120244979 | 120245050 | − | — |
| hsa-mir-1471 | MI0007076 | — | chr2 | 231892242 | 231892298 | − | — |
| hsa-mir-1470 | MI0007075 | — | chr19 | 15449548 | 15449608 | + | — |
| hsa-mir-146b | MI0003129 | 2237 | chr10 | 102436512 | 102436584 | + | ✓ |
| hsa-mir-146a | MI0000477 | 2369 | chr5 | 160485352 | 160485450 | + | ✓ |
| hsa-mir-1469 | MI0007074 | 10 | chr15 | 96333261 | 96333307 | + | — |
| hsa-mir-1468 | MI0003782 | — | chrX | 63786002 | 63786087 | − | — |
| hsa-mir-145 | MI0000461 | 29896 | chr5 | 149430646 | 149430733 | + | ✓ |
| hsa-mir-144 | MI0000460 | 640 | chr17 | 28861533 | 28861618 | − | ✓ |
| hsa-mir-143 | MI0000459 | 104879 | chr5 | 149428918 | 149429023 | + | ✓ |
| hsa-mir-142 | MI0000458 | 3620 | chr17 | 58331232 | 58331318 | − | ✓ |
| hsa-mir-141 | MI0000457 | 1700 | chr12 | 6964097 | 6964191 | + | ✓ |
| hsa-mir-140 | MI0000456 | 5403 | chr16 | 69933081 | 69933180 | + | ✓ |
| hsa-mir-139 | MI0000261 | 195 | chr11 | 72615063 | 72615130 | − | ✓ |
| hsa-mir-138-2 | MI0000455 | 159 | chr16 | 56858518 | 56858601 | + | ✓ |
| hsa-mir-138-1 | MI0000476 | 180 | chr3 | 44114212 | 44114310 | + | ✓ |
| hsa-mir-137 | MI0000454 | 246 | chr1 | 98046070 | 98046171 | − | ✓ |
| hsa-mir-136 | MI0000475 | 77 | chr14 | 100884702 | 100884783 | + | ✓ |
| hsa-mir-135b | MI0000810 | 189 | chr1 | 205448302 | 205448398 | − | ✓ |
| hsa-mir-135a-2 | MI0000453 | 444 | chr12 | 97563812 | 97563911 | + | ✓ |
| hsa-mir-135a-1 | MI0000452 | 590 | chr3 | 52294219 | 52294308 | − | ✓ |
| hsa-mir-1343 | MI0017320 | — | chr11 | 34941837 | 34941920 | + | ✓ |
| hsa-mir-134 | MI0000474 | 118 | chr14 | 101054687 | 101054759 | + | ✓ |
| hsa-mir-133b | MI0000822 | 224 | chr6 | 52148923 | 52149041 | + | ✓ |
| hsa-mir-133a-2 | MI0000451 | 543 | chr20 | 62564912 | 62565013 | + | ✓ |
| hsa-mir-133a-1 | MI0000450 | 543 | chr18 | 21825698 | 21825785 | − | ✓ |
| hsa-mir-1324 | MI0006657 | — | chr3 | 75630763 | 75630858 | + | — |
| hsa-mir-1323 | MI0003786 | 7 | chr19 | 53671968 | 53672040 | + | — |
| hsa-mir-1322 | MI0006653 | — | chr8 | 10825373 | 10825443 | − | — |
| hsa-mir-1321 | MI0006652 | — | chrX | 85835780 | 85835858 | + | — |
| hsa-mir-132 | MI0000449 | 751 | chr17 | 2049908 | 2050008 | − | ✓ |
| hsa-mir-130b | MI0000748 | 869 | chr22 | 21653304 | 21653385 | + | ✓ |
| hsa-mir-130a | MI0000448 | 1813 | chr11 | 57641198 | 57641286 | + | ✓ |
| hsa-mir-1307 | MI0006444 | 249 | chr10 | 103394253 | 103394401 | − | ✓ |
| hsa-mir-1306 | MI0006443 | 6 | chr22 | 20086058 | 20086142 | + | ✓ |
| hsa-mir-1305 | MI0006372 | — | chr4 | 182169293 | 182169378 | + | — |
| hsa-mir-1304 | MI0006371 | 51 | chr11 | 93733674 | 93733764 | − | ✓ |

TABLE 2-continued

| miRNA ID | Accession | RPM | Chromosome | Start | End | Strand | Confidence |
|---|---|---|---|---|---|---|---|
| hsa-mir-1303 | MI0006370 | 48 | chr5 | 154685776 | 154685861 | + | — |
| hsa-mir-1302-9 | MI0015978 | 2 | chr9 | 30144 | 30281 | + | — |
| hsa-mir-1302-8 | MI0006369 | — | chr9 | 97363554 | 97363681 | − | — |
| hsa-mir-1302-7 | MI0006368 | 29 | chr8 | 141786242 | 141786313 | − | — |
| hsa-mir-1302-6 | MI0006367 | — | chr7 | 18127220 | 18127309 | − | — |
| hsa-mir-1302-5 | MI0006366 | — | chr20 | 50614636 | 50614785 | − | — |
| hsa-mir-1302-4 | MI0006365 | 1 | chr2 | 207269275 | 207269424 | − | — |
| hsa-mir-1302-3 | MI0006364 | 2 | chr2 | 113582959 | 113583096 | − | — |
| hsa-mir-1302-2 | MI0006363 | 2 | chr1 | 30366 | 30503 | + | — |
| hsa-mir-1302-11 | MI0015980 | 2 | chr19 | 71973 | 72110 | + | — |
| hsa-mir-1302-10 | MI0015979 | 2 | chr15 | 101960459 | 101960596 | − | — |
| hsa-mir-1302-1 | MI0006362 | — | chr12 | 112695034 | 112695176 | − | — |
| hsa-mir-1301 | MI0003815 | 50 | chr2 | 25328640 | 25328721 | − | ✓ |
| hsa-mir-1299 | MI0006359 | 6 | chr9 | 40929010 | 40929092 | − | — |
| hsa-mir-1298 | MI0003938 | 2 | chrX | 114715233 | 114715344 | + | ✓ |
| hsa-mir-1297 | MI0006358 | — | chr13 | 54311972 | 54312048 | − | — |
| hsa-mir-1296 | MI0003780 | 27 | chr10 | 63372957 | 63373048 | − | ✓ |
| hsa-mir-1295b | MI0019146 | — | chr1 | 171101739 | 171101798 | + | — |
| hsa-mir-1295a | MI0006357 | 1 | chr1 | 171101728 | 171101806 | − | — |
| hsa-mir-1294 | MI0006356 | 6 | chr5 | 154347106 | 154347247 | + | ✓ |
| hsa-mir-1293 | MI0006355 | 4 | chr12 | 50234142 | 50234212 | − | — |
| hsa-mir-1292 | MI0006433 | — | chr20 | 2652777 | 2652842 | + | — |
| hsa-mir-1291 | MI0006353 | 8 | chr12 | 48654444 | 48654530 | − | — |
| hsa-mir-1290 | MI0006352 | 798 | chr1 | 18897071 | 18897148 | − | — |
| hsa-mir-129-2 | MI0000473 | 68 | chr11 | 43581394 | 43581483 | + | ✓ |
| hsa-mir-129-1 | MI0000252 | 69 | chr7 | 128207872 | 128207943 | + | ✓ |
| hsa-mir-1289-2 | MI0006351 | 41 | chr5 | 133427596 | 133427706 | − | — |
| hsa-mir-1289-1 | MI0006350 | 146 | chr20 | 35453954 | 35454097 | − | — |
| hsa-mir-1288 | MI0006432 | — | chr17 | 16282014 | 16282088 | + | — |
| hsa-mir-1287 | MI0006349 | 7 | chr10 | 98395218 | 98395307 | − | ✓ |
| hsa-mir-1286 | MI0006348 | — | chr22 | 20249134 | 20249211 | − | — |
| hsa-mir-1285-2 | MI0006347 | 17 | chr2 | 70252918 | 70253005 | − | — |
| hsa-mir-1285-1 | MI0006346 | 392 | chr7 | 92204015 | 92204098 | − | ✓ |
| hsa-mir-1284 | MI0006431 | — | chr3 | 71541970 | 71542089 | − | ✓ |
| hsa-mir-1283-2 | MI0006430 | 102 | chr19 | 53758232 | 53758318 | + | — |
| hsa-mir-1283-1 | MI0003832 | 114 | chr19 | 53688481 | 53688567 | + | — |
| hsa-mir-1282 | MI0006429 | 115 | chr15 | 43793659 | 43793759 | − | — |
| hsa-mir-1281 | MI0006428 | — | chr22 | 41092513 | 41092566 | + | — |
| hsa-mir-128-2 | MI0000727 | 690 | chr3 | 35744476 | 35744559 | + | ✓ |

TABLE 2-continued

| miRNA ID | Accession | RPM | Chromosome | Start | End | Strand | Confidence |
|---|---|---|---|---|---|---|---|
| hsa-mir-128-1 | MI0000447 | 693 | chr2 | 135665397 | 135665478 | + | ✓ |
| hsa-mir-1279 | MI0006426 | — | chr12 | 69273157 | 69273218 | − | — |
| hsa-mir-1278 | MI0006425 | — | chr1 | 193136503 | 193136583 | + | ✓ |
| hsa-mir-1277 | MI0006419 | 41 | chrX | 118386394 | 118386471 | + | ✓ |
| hsa-mir-1276 | MI0006416 | — | chr15 | 85770496 | 85770578 | − | — |
| hsa-mir-1275 | MI0006415 | 241 | chr6 | 33999972 | 34000051 | − | — |
| hsa-mir-1273h | MI0025512 | 23 | chr16 | 24203116 | 24203231 | + | — |
| hsa-mir-1273c | MI0014171 | 12 | chr6 | 154853360 | 154853436 | + | ✓ |
| hsa-mir-1272 | MI0006408 | 67 | chr15 | 64762387 | 64762515 | − | — |
| hsa-mir-1271 | MI0003814 | 36 | chr5 | 176367946 | 176368031 | + | ✓ |
| hsa-mir-1270 | MI0006407 | — | chr19 | 20399272 | 20399354 | − | — |
| hsa-mir-127 | MI0000472 | 395 | chr14 | 100882979 | 100883075 | + | ✓ |
| hsa-mir-1269b | MI0016888 | 77 | chr17 | 12917268 | 12917342 | − | — |
| hsa-mir-1269a | MI0006406 | 82 | chr4 | 66276824 | 66276928 | + | ✓ |
| hsa-mir-1268b | MI0016748 | 53 | chr17 | 80098828 | 80098877 | + | — |
| hsa-mir-1268a | MI0006405 | 95 | chr15 | 22225278 | 22225329 | − | — |
| hsa-mir-1267 | MI0006404 | 3 | chr13 | 107531171 | 107531248 | − | — |
| hsa-mir-1266 | MI0006403 | — | chr15 | 52277117 | 52277200 | − | — |
| hsa-mir-1265 | MI0006401 | — | chr10 | 14436576 | 14436661 | + | — |
| hsa-mir-1264 | MI0003758 | 1 | chrX | 114652655 | 114652723 | + | — |
| hsa-mir-1263 | MI0006398 | — | chr3 | 164171471 | 164171556 | − | — |
| hsa-mir-1262 | MI0006397 | — | chr1 | 68183518 | 68183610 | − | — |
| hsa-mir-1261 | MI0006396 | 64 | chr11 | 90869121 | 90869202 | − | — |
| hsa-mir-1260b | MI0014197 | 913 | chr11 | 96341438 | 96341526 | + | — |
| hsa-mir-1260a | MI0006394 | 898 | chr14 | 77266218 | 77266290 | + | — |
| hsa-mir-126 | MI0000471 | 4481 | chr9 | 136670602 | 136670686 | + | ✓ |
| hsa-mir-125b-2 | MI0000470 | 11409 | chr21 | 16590237 | 16590325 | + | ✓ |
| hsa-mir-125b-1 | MI0000446 | 13830 | chr11 | 122099757 | 122099844 | − | ✓ |
| hsa-mir-125a | MI0000469 | 3993 | chr19 | 51693254 | 51693339 | + | ✓ |
| hsa-mir-1258 | MI0006392 | — | chr2 | 179860836 | 179860908 | − | — |
| hsa-mir-1257 | MI0006391 | 8 | chr20 | 61953546 | 61953662 | − | — |
| hsa-mir-1256 | MI0006390 | — | chr1 | 20988314 | 20988432 | − | ✓ |
| hsa-mir-1255b-2 | MI0006436 | 4 | chr1 | 167998660 | 167998726 | + | — |
| hsa-mir-1255b-1 | MI0006435 | 4 | chr4 | 36426366 | 36426428 | − | — |
| hsa-mir-1255a | MI0006389 | 6 | chr4 | 101330302 | 101330414 | − | ✓ |
| hsa-mir-1253 | MI0006387 | — | chr17 | 2748078 | 2748182 | − | — |
| hsa-mir-1252 | MI0006434 | — | chr12 | 79419257 | 79419321 | + | — |
| hsa-mir-1251 | MI0006386 | — | chr12 | 97491909 | 97491978 | + | — |
| hsa-mir-1250 | MI0006385 | 41 | chr17 | 81133196 | 81133308 | − | — |

TABLE 2-continued

| miRNA ID | Accession | RPM | Chromosome | Start | End | Strand | Confidence |
|---|---|---|---|---|---|---|---|
| hsa-mir-1249 | MI0006384 | 9 | chr22 | 45200954 | 45201019 | − | ✓ |
| hsa-mir-1248 | MI0006383 | 7 | chr3 | 186786672 | 186786777 | + | − |
| hsa-mir-1247 | MI0006382 | 25 | chr14 | 101560287 | 101560422 | − | ✓ |
| hsa-mir-1246 | MI0006381 | 7472 | chr2 | 176600980 | 176601052 | − | − |
| hsa-mir-1245b | MI0017431 | − | chr2 | 188978093 | 188978161 | − | − |
| hsa-mir-1245a | MI0006380 | − | chr2 | 188978092 | 188978161 | + | − |
| hsa-mir-1244-4 | MI0031511 | − | chr12 | 12111952 | 12112036 | + | − |
| hsa-mir-1244-3 | MI0015975 | − | chr12 | 9239467 | 9239551 | − | − |
| hsa-mir-1244-2 | MI0015974 | − | chr5 | 118974586 | 118974670 | + | − |
| hsa-mir-1244-1 | MI0006379 | − | chr2 | 231713314 | 231713398 | + | − |
| hsa-mir-1243 | MI0006373 | − | chr4 | 113106863 | 113106955 | + | − |
| hsa-mir-124-3 | MI0000445 | 256 | chr20 | 63178500 | 63178586 | + | ✓ |
| hsa-mir-124-2 | MI0000444 | 247 | chr8 | 64379149 | 64379257 | + | ✓ |
| hsa-mir-124-1 | MI0000443 | 254 | chr8 | 9903388 | 9903472 | − | ✓ |
| hsa-mir-1238 | MI0006328 | − | chr19 | 10552122 | 10552204 | + | − |
| hsa-mir-1237 | MI0006327 | − | chr11 | 64368602 | 64368703 | + | − |
| hsa-mir-1236 | MI0006326 | − | chr6 | 31956839 | 31956940 | − | − |
| hsa-mir-1234 | MI0006324 | 1236 | chr8 | 144400086 | 144400165 | − | − |
| hsa-mir-1233-2 | MI0015973 | 2 | chr15 | 34528290 | 34528371 | − | − |
| hsa-mir-1233-1 | MI0006323 | 2 | chr15 | 34382069 | 34382150 | − | − |
| hsa-mir-1231 | MI0006321 | − | chr1 | 201808611 | 201808702 | + | − |
| hsa-mir-122b | MI0017383 | 136 | chr18 | 58451080 | 58451152 | − | ✓ |
| hsa-mir-1229 | MI0006319 | 3 | chr5 | 179798278 | 179798346 | − | − |
| hsa-mir-1228 | MI0006318 | 4 | chr12 | 57194504 | 57194576 | + | − |
| hsa-mir-1227 | MI0006316 | − | chr19 | 2234062 | 2234149 | − | − |
| hsa-mir-1226 | MI0006313 | 5 | chr3 | 47849555 | 47849629 | + | − |
| hsa-mir-1225 | MI0006311 | − | chr16 | 2090195 | 2090284 | − | − |
| hsa-mir-1224 | MI0003764 | 18 | chr3 | 184241405 | 184241489 | + | − |
| hsa-mir-122 | MI0000442 | 1201 | chr18 | 58451074 | 58451158 | + | ✓ |
| hsa-mir-12136 | MI0039740 | 457 | chr1 | 632615 | 632685 | − | − |
| hsa-mir-12135 | MI0039739 | 225 | chr15 | 73299910 | 73299979 | + | − |
| hsa-mir-12133 | MI0039735 | − | chr1 | 94543702 | 94543779 | + | − |
| hsa-mir-12132 | MI0039734 | − | chr1 | 61846075 | 61846176 | + | − |
| hsa-mir-12131 | MI0039733 | − | chr6 | 151102675 | 151102776 | + | − |
| hsa-mir-12130 | MI0039732 | − | chr5 | 116255743 | 116255834 | + | − |
| hsa-mir-12129 | MI0039731 | − | chrX | 153335462 | 153335537 | + | − |
| hsa-mir-12128 | MI0039730 | 55 | chr16 | 85207796 | 85207895 | + | − |
| hsa-mir-12127 | MI0039729 | − | chr3 | 10280351 | 10280452 | + | − |
| hsa-mir-12126 | MI0039728 | 18 | chr9 | 130241387 | 130241488 | + | − |

TABLE 2-continued

| miRNA ID | Accession | RPM | Chromosome | Start | End | Strand | Confidence |
|---|---|---|---|---|---|---|---|
| hsa-mir-12125 | MI0039727 | — | chr5 | 168165845 | 168165929 | + | — |
| hsa-mir-12124 | MI0039726 | 6 | chr3 | 128846808 | 128846908 | + | — |
| hsa-mir-12123 | MI0039725 | — | chr8 | 79332188 | 79332274 | + | — |
| hsa-mir-12122 | MI0039724 | — | chr20 | 49863859 | 49863953 | + | — |
| hsa-mir-12121 | MI0039723 | 35 | chr14 | 104865314 | 104865411 | + | — |
| hsa-mir-12120 | MI0039722 | — | chrY | 13479177 | 13479266 | + | — |
| hsa-mir-12119 | MI0039721 | — | chr7 | 99409172 | 99409264 | + | — |
| hsa-mir-12118 | MI0039720 | — | chr5 | 173303730 | 173303817 | + | — |
| hsa-mir-12117 | MI0039719 | 12 | chr9 | 33108692 | 33108765 | + | — |
| hsa-mir-12116 | MI0039718 | 59 | chr1 | 179803924 | 179804025 | + | — |
| hsa-mir-12115 | MI0039717 | 100 | chr4 | 22515312 | 22515385 | + | — |
| hsa-mir-12114 | MI0039716 | 13 | chr22 | 50407442 | 50407524 | + | — |
| hsa-mir-12113 | MI0039715 | — | chr4 | 11783178 | 11783248 | + | — |
| hsa-mir-1208 | MI0006341 | — | chr8 | 128150116 | 128150188 | + | — |
| hsa-mir-1207 | MI0006340 | — | chr8 | 128049152 | 128049238 | + | — |
| hsa-mir-1206 | MI0006339 | — | chr8 | 128008898 | 128008956 | + | — |
| hsa-mir-1205 | MI0006338 | — | chr8 | 127960633 | 127960695 | + | — |
| hsa-mir-1204 | MI0006337 | — | chr8 | 127795962 | 127796028 | + | — |
| hsa-mir-1203 | MI0006335 | — | chr17 | 48156427 | 48156511 | − | — |
| hsa-mir-1202 | MI0006334 | 28 | chr6 | 155946797 | 155946879 | + | — |
| hsa-mir-1200 | MI0006332 | — | chr7 | 36919357 | 36919432 | − | — |
| hsa-mir-1199 | MI0020340 | — | chr19 | 14073361 | 14073479 | + | — |
| hsa-mir-1197 | MI0006656 | — | chr14 | 101025564 | 101025651 | + | — |
| hsa-mir-1193 | MI0014205 | 52 | chr14 | 101030052 | 101030129 | + | — |
| hsa-mir-1185-2 | MI0003821 | 2 | chr14 | 101044198 | 101044283 | + | ✓ |
| hsa-mir-1185-1 | MI0003844 | 2 | chr14 | 101042977 | 101043062 | + | ✓ |
| hsa-mir-1184-3 | MI0015972 | 180 | chrX | 155457517 | 155457615 | + | — |
| hsa-mir-1184-2 | MI0015971 | 180 | chrX | 155383100 | 155383198 | − | — |
| hsa-mir-1184-1 | MI0006277 | 180 | chrX | 154887360 | 154887458 | − | — |
| hsa-mir-1183 | MI0006276 | — | chr7 | 21471058 | 21471146 | + | — |
| hsa-mir-1182 | MI0006275 | — | chr1 | 231019828 | 231019924 | − | — |
| hsa-mir-1181 | MI0006274 | 3 | chr19 | 10403458 | 10403538 | − | — |
| hsa-mir-1180 | MI0006273 | 103 | chr17 | 19344506 | 19344574 | − | ✓ |
| hsa-mir-1179 | MI0006272 | — | chr15 | 88608107 | 88608197 | + | — |
| hsa-mir-1178 | MI0006271 | — | chr12 | 119713634 | 119713724 | − | — |
| hsa-mir-11401 | MI0036560 | 8 | chr16 | 87853896 | 87853964 | + | — |
| hsa-mir-11400 | MI0036559 | 12 | chr7 | 142474527 | 142474603 | + | — |
| hsa-mir-11399 | MI0036558 | — | chr1 | 112882050 | 112882129 | + | — |
| hsa-mir-11181 | MI0035972 | — | chr15 | 87946206 | 87946268 | − | — |

TABLE 2-continued

| miRNA ID | Accession | RPM | Chromosome | Start | End | Strand | Confidence |
|---|---|---|---|---|---|---|---|
| hsa-mir-10b | MI0000267 | 7790 | chr2 | 176150303 | 176150412 | + | — |
| hsa-mir-10a | MI0000266 | 5181 | chr17 | 48579838 | 48579947 | − | ✓ |
| hsa-mir-107 | MI0000114 | 11858 | chr10 | 89592747 | 89592827 | − | ✓ |
| hsa-mir-106b | MI0000734 | 1841 | chr7 | 100093993 | 100094074 | − | ✓ |
| hsa-mir-106a | MI0000113 | 7942 | chrX | 134170198 | 134170278 | − | ✓ |
| hsa-mir-10527 | MI0033674 | 2 | chr12 | 63823663 | 63823727 | + | — |
| hsa-mir-10526 | MI0033673 | — | chr11 | 122152103 | 122152156 | − | — |
| hsa-mir-10525 | MI0033672 | — | chr7 | 74595968 | 74596026 | + | — |
| hsa-mir-10524 | MI0033671 | 12 | chr6 | 78539263 | 78539309 | − | — |
| hsa-mir-10523 | MI0033669 | 36 | chr5 | 172915083 | 172915158 | + | — |
| hsa-mir-10522 | MI0033668 | — | chr5 | 17155930 | 17155992 | − | — |
| hsa-mir-105-2 | MI0000112 | 15 | chrX | 152394412 | 152394492 | − | ✓ |
| hsa-mir-105-1 | MI0000111 | 15 | chrX | 152392219 | 152392299 | − | ✓ |
| hsa-mir-10401 | MI0033425 | 156 | chr21 | 8206563 | 8206618 | + | — |
| hsa-mir-10400 | MI0033424 | 16 | chr8 | 144462485 | 144462539 | − | — |
| hsa-mir-103b-2 | MI0007262 | — | chr20 | 3917502 | 3917563 | − | — |
| hsa-mir-103b-1 | MI0007261 | 233 | chr5 | 168560904 | 168560965 | + | — |
| hsa-mir-103a-2 | MI0000108 | 12432 | chr20 | 3917494 | 3917571 | + | ✓ |
| hsa-mir-103a-1 | MI0000109 | 12432 | chr5 | 168560896 | 168560973 | − | ✓ |
| hsa-mir-10399 | MI0033423 | 19 | chr7 | 139044100 | 139044157 | − | — |
| hsa-mir-10398 | MI0033422 | 8 | chr6 | 41733554 | 41733610 | − | — |
| hsa-mir-10397 | MI0033421 | — | chr5 | 10402364 | 10402431 | + | — |
| hsa-mir-10396b | MI0033426 | — | chr21 | 8436324 | 8436374 | + | ✓ |
| hsa-mir-10396a | MI0033420 | — | chr21 | 8987617 | 8987665 | + | — |
| hsa-mir-10395 | MI0033419 | — | chr19 | 12703601 | 12703664 | − | — |
| hsa-mir-10394 | MI0033418 | — | chr19 | 58393364 | 58393446 | + | — |
| hsa-mir-10393 | MI0033417 | — | chr15 | 44717844 | 44717893 | + | — |
| hsa-mir-10392 | MI0033416 | 8 | chr11 | 64878523 | 64878609 | − | — |
| hsa-mir-10226 | MI0033056 | 169 | chr17 | 48032882 | 48032951 | + | — |
| hsa-mir-101-2 | MI0000739 | 6084 | chr9 | 4850297 | 4850375 | + | ✓ |
| hsa-mir-101-1 | MI0000103 | 6056 | chr1 | 65058434 | 65058508 | − | ✓ |
| hsa-mir-100 | MI0000102 | 10013 | chr11 | 122152229 | 122152308 | − | ✓ |
| hsa-mir-1-2 | MI0000437 | 13316 | chr18 | 21829004 | 21829088 | − | — |
| hsa-mir-1-1 | MI0000651 | 6511 | chr20 | 62554306 | 62554376 | + | ✓ |
| hsa-let-7i | MI0000434 | 17040 | chr12 | 62603686 | 62603769 | + | ✓ |
| hsa-let-7g | MI0000433 | 102832 | chr3 | 52268278 | 52268361 | − | ✓ |
| hsa-let-7f-2 | MI0000068 | 118700 | chrX | 53557192 | 53557274 | − | ✓ |
| hsa-let-7f-1 | MI0000067 | 109279 | chr9 | 94176347 | 94176433 | + | ✓ |
| hsa-let-7e | MI0000066 | 50938 | chr19 | 51692786 | 51692864 | + | ✓ |

TABLE 2-continued

| miRNA ID | Accession | RPM | Chromosome | Start | End | Strand | Confidence |
|----------|-----------|-----|------------|-------|-----|--------|------------|
| hsa-let-7d | MI0000065 | 4649 | chr9 | 94178834 | 94178920 | + | ✓ |
| hsa-let-7c | MI0000064 | 135622 | chr21 | 16539828 | 16539911 | + | ✓ |
| hsa-let-7b | MI0000063 | 83403 | chr22 | 46113686 | 46113768 | + | ✓ |
| hsa-let-7a-3 | MI0000062 | 142757 | chr22 | 46112749 | 46112822 | + | ✓ |
| hsa-let-7a-2 | MI0000061 | 142652 | chr11 | 122146522 | 122146593 | − | ✓ |
| hsa-let-7a-1 | MI0000060 | 145261 | chr9 | 94175957 | 94176036 | + | ✓ |

AAV

Recombinant AAV genomes of the disclosure comprise a disclosed nucleic acid molecule and one or more AAV ITRs flanking a nucleic acid molecule. AAV DNA in the rAAV genomes may be from any AAV serotype for which a recombinant virus can be derived including, but not limited to, AAV serotypes AAV-B1, AAVrh.74, AAV-1, AAV-2, AAV-3, AAV-4, AAV-5, AAV-6, AAV-7, AAV-8, AAV-9, AAV-10, AAV-11, AAV-12 and AAV-13. Production of pseudotyped rAAV is disclosed in, for example, WO 01/83692. Other types of rAAV variants, for example rAAV with capsid mutations, are also contemplated. See, for example, Marsic et al., Molecular Therapy, 22(11): 1900-1909 (2014). As noted in the Background section above, the nucleotide sequences of the genomes of various AAV sero-types are known in the art. To promote skeletal muscle specific expression, AAV1, AAV5, AAV6, AAV8 or AAV9 may be used.

Self-complementary AAV (scAAV) vectors are also con-templated for use in the present disclosure. scAAV vectors are generated by reducing the vector size to approximately 2500 base pairs, which comprise 2200 base pairs of unique transgene sequence plus two copies of the 145 base pair ITR packaged as a dimer. The scAAV have the ability to re-fold into double stranded DNA templates for expression. McCa-rthy, *Mol. Therap.* 16(10): 1648-1656, 2008.

DNA plasmids of the disclosure comprise a rAAV genome. The DNA plasmids are transferred to cells permis-sible for infection with a helper virus of AAV (e.g., adeno-virus, El-deleted adenovirus or herpesvirus) for assembly of the rAAV genome into infectious viral particles. Techniques to produce rAAV particles, in which an AAV genome to be packaged, rep and cap genes, and helper virus functions are provided to a cell, are known in the art. Production of rAAV requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived and may be from a different AAV serotype than the rAAV genome ITRs, includ-ing, but not limited to, AAV serotypes AAV-1, AAV-2, AAV-3, AAV-4, AAV-5, AAV-6, AAV-7, AAV-8, AAV-9, AAV-10, AAV-11, AAV-12 and AAV-13. Production of pseudotyped rAAV is disclosed in, for example, WO 01/83692 which is incorporated by reference herein in its entirety.

A method of generating a packaging cell is to create a cell line that stably expresses all the necessary components for AAV particle production. For example, a plasmid (or mul-tiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleav-age sites (Laughlin et al., 1983, Gene, 23:65-73) or by direct, blunt-end ligation (Senapathy & Carter, 1984, J. Biol. Chem., 259:4661-4666). The packaging cell line is then infected with a helper virus such as adenovirus. The advan-tages of this method are that the cells are selectable and are suitable for large-scale production of rAAV. Other examples of suitable methods employ adenovirus or baculovirus rather than plasmids to introduce rAAV genomes and/or rep and cap genes into packaging cells.

General principles of rAAV production are reviewed in, for example, Carter, 1992, Current Opinions in Biotechnol-ogy, 1533-539; and Muzyczka, 1992, Curr. Topics in Micro-bial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658.776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Patent. No. 5,786,211; U.S. Patent No. 5,871,982; and U.S. Pat No. 6,258,595. The foregoing documents are hereby incorporated by reference in their entirety herein, with particular emphasis on those sections of the documents relating to rAAV production.

The disclosure thus provides packaging cells that produce infectious rAAV. In one embodiment packaging cells may be stably transformed cancer cells such as HeLa cells, 293 cells and PerC.6 cells (a cognate 293 line). In another embodi-ment, packaging cells are cells that are not transformed cancer cells, such as low passage 293 cells (human fetal kidney cells transformed with El of adenovirus), MRC-5 cells (human fetal fibroblasts), WI-38 cells (human fetal fibroblasts), Vero cells (monkey kidney cells) and FRhL-2 cells (rhesus fetal lung cells).

Recombinant AAV (i.e., infectious encapsidated rAAV particles) of the disclosure comprise a rAAV genome. Embodiments include, but are not limited to, the rAAV named "AAV.miDUX4.405" including a genome encoding the DUX4 miRNA hDux.mi405 (encoded by the DNA set out in SEQ ID NO: 1 and the rAAV named "AAV.miDUX4.1155" including a genome encoding the DUX4 miRNA hDux.mil155 (encoded by the DNA set out in SEQ ID NO: 2). In exemplary embodiments, the genomes of both rAAV lack AAV rep and cap DNA, that is, there is no AAV rep or cap DNA between the ITRs of the genomes. Examples of rAAV that may be constructed to comprise the nucleic acid molecules of the disclosure are set out in International Patent Application No. PCT/US2012/047999 (WO 2013/016352) incorporated by reference herein in its entirety.

The rAAV may be purified by methods such as by column chromatography or cesium chloride gradients. Methods for purifying rAAV vectors from helper virus are known in the art and include methods disclosed in, for example, Clark et al., Hum. Gene Ther., 10(6): 1031-1039 (1999); Schenpp and Clark, Methods Mol. Med., 69 427-443 (2002); U.S. Pat. No. 6,566,118 and WO 98/09657.

In another embodiment, the disclosure contemplates compositions comprising a disclosed rAAV. Compositions of the disclosure comprise rAAV in a pharmaceutically acceptable carrier. The compositions may also comprise other ingredients such as diluents and adjuvants. Acceptable carriers, diluents and adjuvants are nontoxic to recipients and are preferably inert at the dosages and concentrations employed, and include buffers such as phosphate, citrate, or other organic acids; antioxidants such as ascorbic acid; low molecular weight polypeptides; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as Tween, pluronics or polyethylene glycol (PEG).

Titers of rAAV to be administered in methods of the disclosure will vary depending, for example, on the particular rAAV, the mode of administration, the treatment goal, the individual, and the cell type(s) being targeted, and may be determined by methods known in the art. Titers of rAAV may range from about $1\times10^6$, about $1\times10^7$, about $1\times10^8$, about $1\times10^9$, about $1\times10^{10}$, about $1\times10^{11}$, about $1\times10^{12}$, about $1\times10^{13}$ to about $1\times10^{14}$ or more DNase resistant particles (DRP) per ml. Dosages may also be expressed in units of viral genomes (vg).

Methods of transducing a target cell with rAAV, in vivo or in vitro, are contemplated by the disclosure. The in vivo methods comprise the step of administering an effective dose, or effective multiple doses, of a composition comprising a rAAV of the disclosure to an animal (including a human being) in need thereof. If the dose is administered prior to development of a disorder/disease, the administration is prophylactic. If the dose is administered after the development of a disorder/disease, the administration is therapeutic. In embodiments of the disclosure, an effective dose is a dose that alleviates (eliminates or reduces) at least one symptom associated with the disorder/disease state being treated, that slows or prevents progression to a disorder/disease state, that slows or prevents progression of a disorder/disease state, that diminishes the extent of disease, that results in remission (partial or total) of disease, and/or that prolongs survival. An example of a disease contemplated for prevention or treatment with the disclosed methods is FSHD.

Combination therapies are also contemplated by the disclosure. Combination as used herein includes both simultaneous treatment and sequential treatments. Combinations of methods of the disclosure with standard medical treatments (e.g., corticosteroids) are specifically contemplated, as are combinations with novel therapies.

Administration of an effective dose of the compositions may be by routes known in the art including, but not limited to, intramuscular, parenteral, intravenous, oral, buccal, nasal, pulmonary, intracranial, intraosseous, intraocular, rectal, or vaginal. Route(s) of administration and serotype(s) of AAV components of the rAAV (in particular, the AAV ITRs and capsid protein) of the disclosure may be chosen and/or matched by those skilled in the art taking into account the infection and/or disease state being treated and the target cells/tissue(s) that are to express the DUX4 miRNAs.

The disclosure provides for local administration and systemic administration of an effective dose of recombinant AAV and compositions of the disclosure. For example, systemic administration is administration into the circulatory system so that the entire body is affected. Systemic administration includes enteral administration such as absorption through the gastrointestinal tract and parental administration through injection, infusion or implantation.

In particular, actual administration of rAAV of the present disclosure may be accomplished by using any physical method that will transport the rAAV recombinant vector into the target tissue of an animal. Administration according to the disclosure includes, but is not limited to, injection into muscle, the bloodstream and/or directly into the liver. Simply resuspending a rAAV in phosphate buffered saline has been demonstrated to be sufficient to provide a vehicle useful for muscle tissue expression, and there are no known restrictions on the carriers or other components that can be co-administered with the rAAV (although compositions that degrade DNA should be avoided in the normal manner with rAAV). Capsid proteins of a rAAV may be modified so that the rAAV is targeted to a particular target tissue of interest such as muscle. See, for example, WO 02/053703, the disclosure of which is incorporated by reference herein. Pharmaceutical compositions can be prepared as injectable formulations or as topical formulations to be delivered to the muscles by transdermal transport. Numerous formulations for both intramuscular injection and transdermal transport have been previously developed and can be used in the practice of the disclosed methods and compositions. The rAAV can be used with any pharmaceutically acceptable carrier for ease of administration and handling.

For purposes of intramuscular injection, solutions in an adjuvant such as sesame or peanut oil or in aqueous propylene glycol can be employed, as well as sterile aqueous solutions. Such aqueous solutions can be buffered, if desired, and the liquid diluent first rendered isotonic with saline or glucose. Solutions of rAAV as a free acid (DNA contains acidic phosphate groups) or a pharmacologically acceptable salt can be prepared in water suitably mixed with a surfactant such as hydroxypropylcellulose. A dispersion of rAAV can also be prepared in glycerol, liquid polyethylene glycols and mixtures thereof and in oils. Under ordinary conditions of storage and use, these preparations contain a preservative to prevent the growth of microorganisms. In this connection, the sterile aqueous media employed are all readily obtainable by techniques known to those skilled in the art.

The pharmaceutical forms suitable for injectable use include sterile aqueous solutions or dispersions and sterile powders for the extemporaneous preparation of sterile injectable solutions or dispersions. In all cases the form must be sterile and must be fluid to the extent that easy syringability exists. It must be stable under the conditions of manufacture and storage and must be preserved against the contaminating actions of microorganisms such as bacteria and fungi. The carrier can be a solvent or dispersion medium containing, for example, water, ethanol, polyol (for example, glycerol, propylene glycol, liquid polyethylene glycol and the like), suitable mixtures thereof, and vegetable oils. The proper fluidity can be maintained, for example, by the use of a coating such as lecithin, by the maintenance of the required particle size in the case of a dispersion and by the use of surfactants. The prevention of the action of microorganisms can be brought about by various antibacterial and antifungal agents, for example, parabens, chlorobutanol, phenol, sorbic acid, thimerosal and the like. In many cases it will be preferable to include isotonic agents, for example, sugars or sodium chloride. Prolonged absorption of the injectable compositions can be brought about by use of agents delaying absorption, for example, aluminum monostearate and gelatin.

Sterile injectable solutions are prepared by incorporating rAAV in the required amount in the appropriate solvent with various other ingredients enumerated above, as required, followed by filter sterilization. Generally, dispersions are prepared by incorporating the sterilized active ingredient into a sterile vehicle which contains the basic dispersion medium and the required other ingredients from those enumerated above. In the case of sterile powders for the preparation of sterile injectable solutions, the preferred methods of preparation are vacuum drying and the freeze drying technique that yield a powder of the active ingredient plus any additional desired ingredient from the previously sterile-filtered solution thereof.

Transduction with rAAV may also be carried out in vitro. In one embodiment, desired target muscle cells are removed from the subject, transduced with rAAV and reintroduced into the subject. Alternatively, syngeneic or xenogeneic muscle cells can be used where those cells will not generate an inappropriate immune response in the subject.

Suitable methods for the transduction and reintroduction of transduced cells into a subject are known in the art. In one embodiment, cells can be transduced in vitro by combining rAAV with muscle cells, e.g., in appropriate media, and screening for those cells harboring the DNA of interest using techniques such as Southern blots and/or PCR, or by using selectable markers. Transduced cells can then be formulated into pharmaceutical compositions, and the composition introduced into the subject by various techniques, such as by intramuscular, intravenous, subcutaneous and intraperitoneal injection, or by injection into smooth and cardiac muscle, using e.g., a catheter.

Transduction of cells with rAAV of the disclosure results in sustained expression of DUX4 miRNAs. The present disclosure thus provides methods of administering/delivering rAAV which express DUX4 miRNAs to an animal, preferably a human being. These methods include transducing tissues (including, but not limited to, tissues such as muscle, organs such as liver and brain, and glands such as salivary glands) with one or more disclosed rAAV. Transduction may be carried out with gene cassettes comprising tissue specific control elements. For example, one embodiment provides methods of transducing muscle cells and muscle tissues directed by muscle specific control elements, including, but not limited to, those derived from the actin and myosin gene families, such as from the myoD gene family [See Weintraub et al., *Science,* 251: 761-766 (1991)], the myocyte-specific enhancer binding factor MEF-2 [Cserjesi and Olson, *Mol Cell Biol* 11: 4854-4862 (1991)], control elements derived from the human skeletal actin gene [Muscat et al., *Mol Cell Biol,* 7: 4089-4099 (1987)], the cardiac actin gene, muscle creatine kinase sequence elements [See Johnson et al., *Mol Cell Biol,* 9:3393-3399 (1989)] and the murine creatine kinase enhancer (mCK) element, control elements derived from the skeletal fast-twitch troponin C gene, the slow-twitch cardiac troponin C gene and the slow-twitch troponin I gene: hypoxia-inducible nuclear factors (Semenza et al., *Proc Natl Acad Sci USA,* 88: 5680-5684 (1991)), steroid-inducible elements and promoters including the glucocorticoid response element (GRE) (See Mader and White, *Proc. Nall. Acad. Sci. USA* 90: 5603-5607 (1993)), and other control elements.

Muscle tissue is an attractive target for in vivo DNA delivery, because it is not a vital organ and is easy to access. The disclosure contemplates sustained expression of miRNAs from transduced myofibers.

By "muscle cell" or "muscle tissue" is meant a cell or group of cells derived from muscle of any kind (for example, skeletal muscle and smooth muscle, e.g. from the digestive tract, urinary bladder, blood vessels or cardiac tissue). Such muscle cells may be differentiated or undifferentiated, such as myoblasts, myocytes, myotubes, cardiomyocytes and cardiomyoblasts.

The term "transduction" is used to refer to the administration/delivery of DUX4 miRNAs to a recipient cell either in vivo or in vitro, via a replication-deficient rAAV resulting in expression of a DUX4 miRNA by the recipient cell.

Thus, the disclosure provides methods of administering an effective dose (or doses, administered essentially simultaneously or doses given at intervals) of rAAV that encode DUX4 miRNAs to a patient in need thereof.

DUX4 and Facioscapulohumeral Muscular Dystrophy

Muscular dystrophies (MDs) are a group of genetic diseases. The group is characterized by progressive weakness and degeneration of the skeletal muscles that control movement or breathing. Some forms of MD develop in infancy or childhood, while others may not appear until middle age or later. The disorders differ in terms of the distribution and extent of muscle weakness (some forms of MD also affect cardiac muscle), the age of onset, the rate of progression, and the pattern of inheritance.

Facioscapulohumeral muscular dystrophy (FSHD) is a complex autosomal dominant disorder characterized by progressive and asymmetric weakness of facial, shoulder and limb muscles. Symptoms typically arise in adulthood with most patients showing clinical features before age thirty. About five percent of patients develop symptoms as infants or juveniles and these are generally more severely affected. Clinical presentation can vary from mild (some limited muscle weakness) to severe (wheelchair dependence). Historically, FSHD was classified as the third most common MD, affecting one in 20,000 individuals worldwide. However, recent data indicate FSHD is the most common MD in Europe, suggesting its worldwide incidence could be as high as 1 in 8,333.

Typical FSHD cases (FSHD1A, heretofore referred to as FSHD) are linked to heterozygous chromosomal deletions that decrease the copy number of 3.3 kilobase (kb) D4Z4 repeats on human chromosome 4q35. Simplistically, normal individuals have 11-100 tandemly-repeated D4Z4 copies on both 4q35 alleles, while patients with FSHD have one normal and one contracted allele containing 1-10 repeats. In addition, FSHD-associated D4Z4 contractions must occur on specific disease-permissive chromosome 4q35 backgrounds (called 4qA). Importantly, no genes are completely lost or structurally mutated as a result of FSHD-associated deletions. Instead, genetic changes associated with FSHD give rise to expression of the toxic DUX4 gene, which is damaging to muscle. FSHD2 (also known as FSHD1B) is phenotypically identical to FSHD1, is associated with DUX4 expression, and requires the 4qA chromosomal background. FSHD2 is not associated with D4Z4 repeat contraction, but is instead caused by mutation in the SMCHD1 gene, which is a chromatin regulator normally involved in repressing the DUX4 locus at 4qA. Mutated SMCHD1 proteins fail to participate in adding heterochromatin to the 4qA DUX4 allele, thereby allowing DUX4 gene expression.

In the leading FSHD pathogenesis model, D4Z4 contractions are proposed to cause epigenetic changes that permit expression of the DUX4 gene. As a result, the aberrant over-expression of otherwise silent or near-silent DUX4 gene, and the genes it regulates, may ultimately cause FSHD. This model is consistent with data showing normal 4q35 D4Z4 repeats have heterochromatin characteristics, while FSHD-linked D4Z4 repeats contain marks more indicative of actively transcribed euchromatin. These transcription-permissive epigenetic changes, coupled with the observation that complete monosomic D4Z4 deletions (i.e., zero repeats) do not cause FSHD, support the hypothesis that D4Z4 repeats harbor potentially myopathic open reading frames (ORFs), which are abnormally expressed in FSHD muscles. This notion was initially considered in 1994, when a D4Z4-localized ORF, called DUX4, was first identified. However, the locus had some characteristics of an unexpressed pseudogene and DUX4 was therefore summarily dismissed as an FSHD candidate. For many years thereafter, the search for FSHD-related genes was mainly focused outside the D4Z4 repeats, and although some intriguing candidates emerged from these studies, no single gene had been conclusively linked to FSHD development. This slow progress led to the re-emergence of DUX4 as an FSHD candidate in 2007. Even as of 2010 though, researchers continued to highlight other genes as candidates. See, for example, Wuebbles et al., *Int. J. Clin. Exp. Pathol.*, 3(4): 386-400 (2010) highlighting the FSHD region gene 1 (frg1). In contrast, Wallace et al., *Mol. Ther.*, 17(Suppl. 1): S151 (2009); Wei et al., *Mol. Ther.*, 17(Suppl. 1): S200 (2009); and the Lemmers et al. report from the *Sciencexpress issue of Aug.* 19, 2010 highlight DUX4. Neguembor and Gabellini, *Epigenomics*, 2(2): 271-287 (2010) is a recent review article regarding FSHD.

The role of DUX4 in FSHD pathogenesis can be explained as follows. First, D4Z4 repeats contain identical DUX4 coding regions, and D4Z4 repeats also harbor smaller sense and antisense transcripts, including some resembling microRNAs. Over-expressed DUX4 transcripts and a ~50 kDa full-length DUX4 protein are found in biopsies and cell lines from FSHD patients. These data are consistent with a transcriptional de-repression model of FSHD pathogenesis. In addition, unlike pseudogenes, D4Z4 repeats and DUX4 likely have functional importance, since tandemly-arrayed D4Z4 repeats are conserved in at least eleven different placental mammalian species (non-placental animals lack D4Z4 repeats), with the greatest sequence conservation occurring within the DUX4 ORF. Second, over-expressed DUX4 is toxic to tissue culture cells and embryonic progenitors of developing lower organisms in vivo. This toxicity occurs at least partly through a pro-apoptotic mechanism, indicated by Caspase-3 activation in DUX4 transfected cells, and presence of TUNEL-positive nuclei in developmentally arrested *Xenopus* embryos injected with DUX4 mRNA at the two-cell stage. These findings are consistent with studies showing some pro-apoptotic proteins, including Caspase-3, are present in FSHD patient muscles. In addition to stimulating apoptosis, DUX4 may negatively regulate myogenesis. Human DUX4 inhibits differentiation of mouse C2C12 myoblasts in vitro, potentially by interfering with PAX3 and/or PAX7, and causes developmental arrest and reduced staining of some muscle markers when delivered to progenitor cells of zebrafish or *Xenopus* embryos. Finally, aberrant DUX4 function is directly associated with potentially important molecular changes seen in FSHD patient muscles. Specifically, full-length human DUX4 encodes an approximately 50 kDa double homeodomain transcription factor, and DUX4 targets can be found at elevated levels in FSHD patient muscles. These data support that DUX4 catalyzes numerous downstream molecular changes that are incompatible with maintaining normal muscle integrity.

BRIEF DESCRIPTION OF THE DRAWING

FIG. 1 shows the wild type U6-1 promoter (SEQ ID NO: 3)

Figure 4:
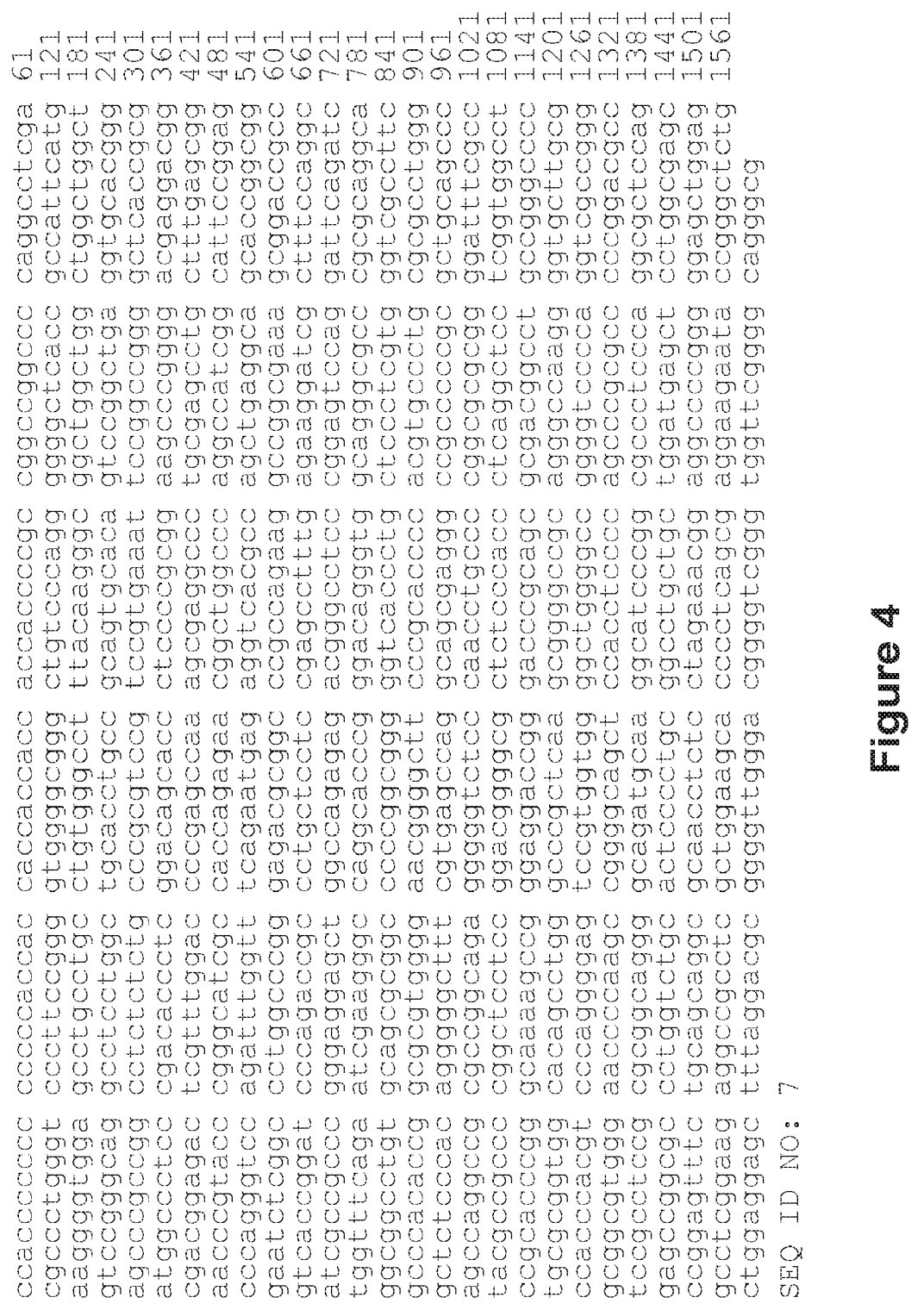

FIG. 4 shows the human DUX4 DNA sequence (SEQ ID NO: 7).

SEQUENCES

SEQ ID NO: 1 (miDUX4.405 or miDUX4-1)
SEQ ID NO: 2 (miDUX4.1155 or miDUX4-2)

SEQ ID NOS: 10-10912, 10971, 10972: Exemplary miRNA mature guide strand nucleotide sequences SEQ ID NO: 3 wild type U6-1 promoter SEQ ID NO: 4 weakened U6-1 promoter with mutations within the PSE region.

SEQ ID NO: 5 Binding site for miR-122 (5' TATT-TAGTGTGAT AATGGTGTTT 3')

SEQ ID NO: 6—Binding site for miRNA-208 (5' ACGAGCcTTTT GCTCGTCTTAT 3')

SEQ ID NO: 8—miDUX4.405 (miDUX4-1) folded miRNA

SEQ ID NO: 9—miDUX4.1155 (miDUX4-2) folded miRNA

SEQ ID NO: 7—DUX4 gene sequence

SEQ ID NOS: 10913-10968 Exemplary nucleic acid sequences comprising the mature guide strand of miDUX4 and a binding site for miR-122 or miR-208 (also shown in Table 1)

SEQ ID NO: 10969—Binding site for miR-122 (5' UAUUUAGU GUGAUAAUGGUGUUU 3')

SEQ ID NO: 10970—Binding site for miR-208 (5' ACGAGCcUUUU GCUCGUCUUAU 3')

SEQ ID NO: 10973—miDUX4.405 (miDUX4-1) mature guide strand nucleotide sequence

SEQ ID NO: 10974—miDUX4.1155 (miDUX4-2) mature guide strand nucleotide sequence

When mature guide stand sequences are presented as DNA sequences herein, one of skill in the art understands that this DNA sequence serves as a template for transcription to RNA wherein the thymidine bases are converted to uridine bases.

Thus, aspects and embodiments of the disclosure are illustrated by the following examples. Example 1 describes the liver and heart detargeted, U6 promoter system. Example 2 describes the luciferase assay for determining the effect of the miRNAs expression of DUX4 miRNAs. Example 3 describes rAAV vectors encoding DUX4 miRNAs.

EXAMPLE 1

Liver and Heart De-Targeted, U6 Promoter System

AAV vectors expressing the miDUX4.405 sequence (SEQ ID NO: 1) from the wild-type U6 promoter were generated. Muscles were co-injected with AAV.DUX4. The wild-type U6 system protected muscles from damage resulting from high DUX4 expression.

Figures 2A, 2B:
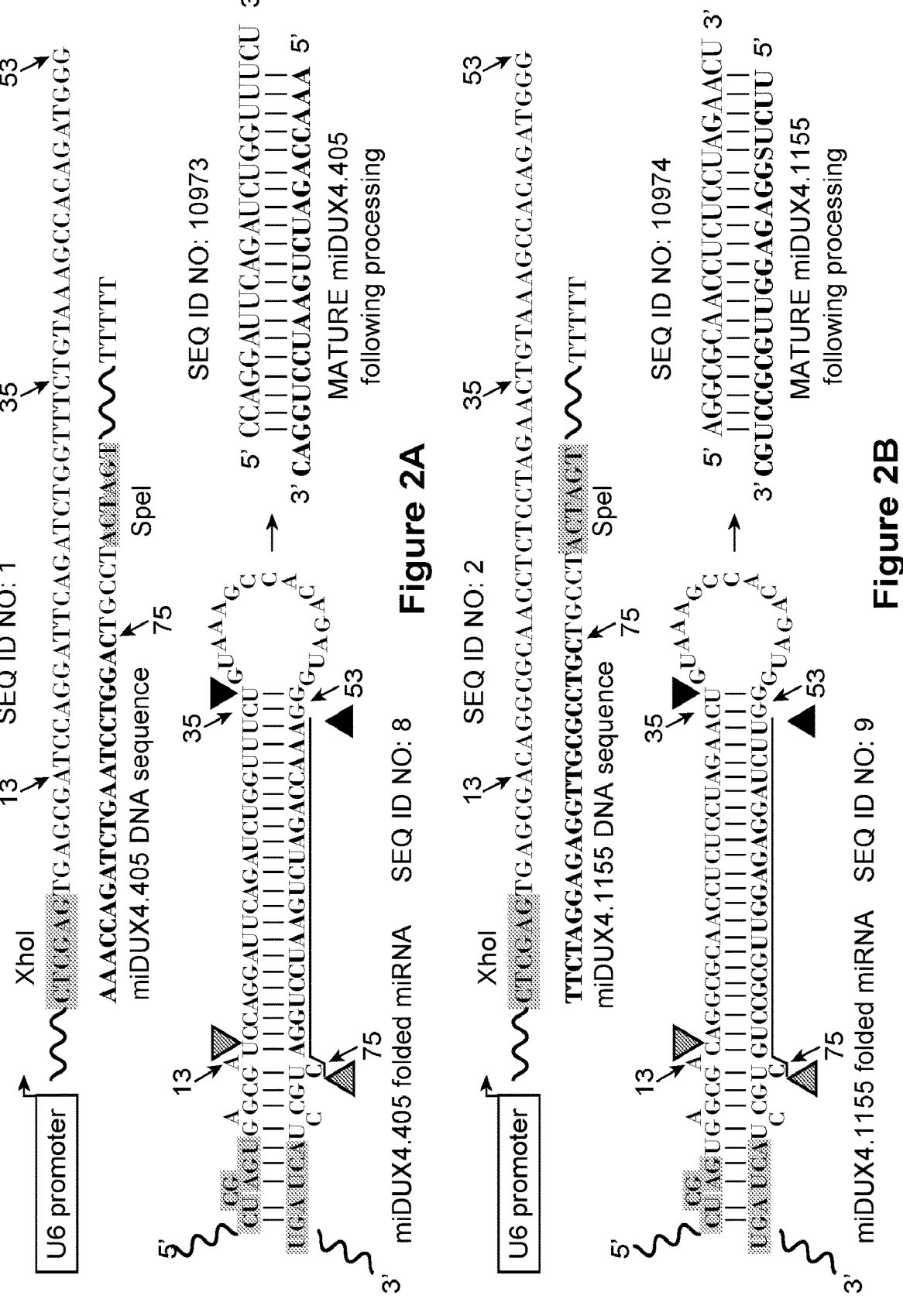
FIGS. 2A and 2B set out sequences of DUX4 targeted miRNAs. In each panel, the top sequences indicate the DNA templates from which each respective miRNA is transcribed. In the top panel, the DNA template miDUX4.405 (miDUX4-1 or mi405) is SEQ ID NO: 1. In the bottom panel, the DNA template miDUX4.1155 (miDUX4-2; or mi1155) is SEQ ID NO: 2. The folded miRNA transcripts are shown as hairpin structures. The miDUX4.405 folded miRNAs is SEQ ID NO: 8. The miDUX4.1155 folded miRNA is SEQ ID NO: 9. The mature miDUX4.405 and miDUX4.1155 sequences arise following processing in target cells by host miRNA processing machinery (including Drosha, DGCR8, Dicer, and Exportin-5). Sequences shaded in gray indicate restriction sites used for cloning each miRNA into the U6T6 vector. CTCGAG is an XhoI site and ACTAGT is a SpeI site (CUCGAG and ACUAGU in RNA, where the U is a uracil base). The red sequence indicates the mature miRNA antisense guide strand that ultimately helps catalyze cleavage of the DUX4 target mRNA. This sequence is also underlined in the miRNA hairpin portions of this diagram. The gray and black arrowheads indicate Drosha- and Dicer- catalyzed cleavage sites, respectively. The numbers 13, 35, 53, and 75 are provided for orientation. The sequences between (and including) positions 35-53 are derived from the natural human mir-30a sequence, except the A at position 39, which is a G is the normal mir-30a sequence. This nucleotide was changed to an A to facilitate folding of the miRNA loop, based on in silico RNA folding models. The base of the stem (5' of position 13 and 3' of position 75) is also derived from mir-30a structure and sequence with some modifications depending on the primary sequence of the guide strand. Specifically, the nucleotide at position 13 can vary to help facilitate a required mismatched between the position 13 and 75 nucleotides. This bulged structure is hypothesized to facilitate proper Drosha cleavage.
Figure 3:
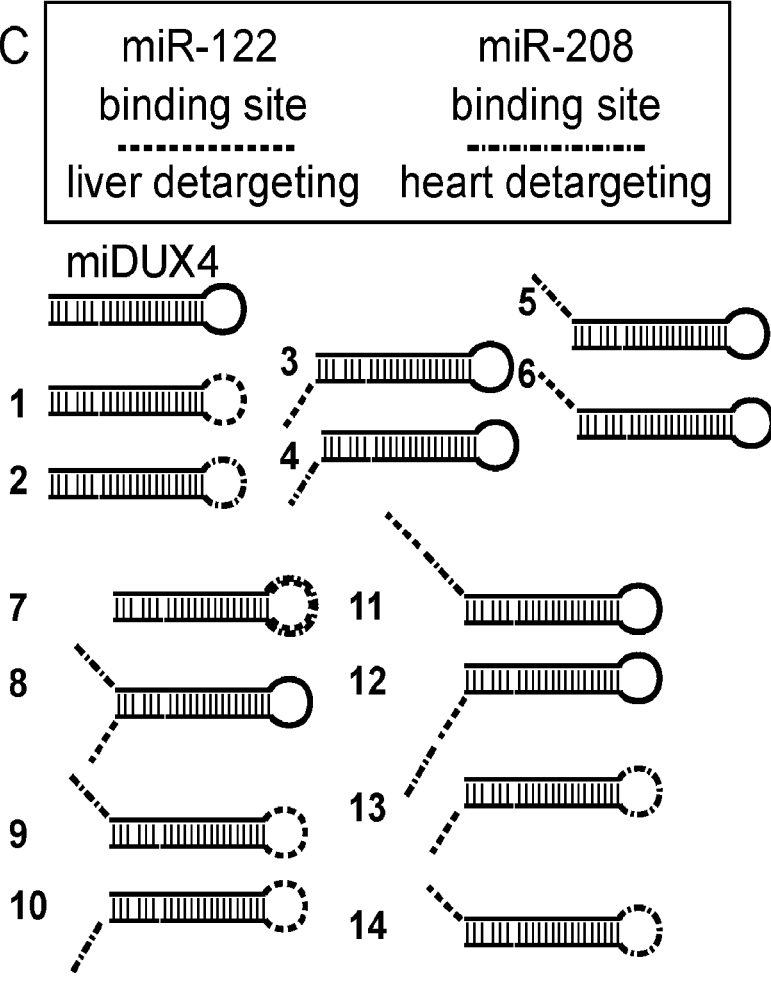
FIG. 3 shows the strategy for de-targeting miDUX4 in heart and liver. The perfect binding sites for mir-122 (liver) and mir-208 (heart) are indicated in the figure. Evidence that mir-122-modified miDUX4 is functional against a DUX4-luciferase target, and that liver cells expressing mir-122 can inhibit miDUX4 silencing when mir-122 binding sites are included in the miDUX4 sequence.

One option for skeletal muscle specific expression is to use the AAV6 vector, as it primarily transduces skeletal muscle, liver, and heart following vascular delivery, and significantly less in other tissues. To avoid expression in liver and heart, the U6 promoter system detargets miDUX4 in those tissues. To do this, binding sites for mir-122 and mir-208) (liver- and heart-specific natural microRNAs) are incorporated at various locations within the miDUX4 transcript as shown in FIG. 3. The de-targeted miDUX4 transcripts expression are measured, using the DUX4-luciferase target described below in Example 2.

EXAMPLE 2

Luciferase Assay for Effect of Expression of DUX4 miRNAs

Expression of the DUX4 target sequence in the presence of the DUX4 miRNAs is assayed. A lipofectamine 2000 transfection is done in 293 cells in a 96-well, white-walled assay plate. 140,000 cells are transfected with 20 ng of a Renilla-firefly plasmid containing the DUX4 target sequence and 180 ng of various DUX4 miRNA-encoding vectors, including U6T6-driven miDux4.405 or miDux4.1155 vectors from Example 1. A luciferase assay is performed 24 hours later.

The media is removed from the cells and 20 μl of lysis buffer was added per well. The plate is put on a shaker for 15 minutes at room temperature before adding 50 μl of luciferase substrate. The first reading is taken 10 minutes later. Next, 50 μl of Stop and Glo luciferase substrate is added and the second reading is taken 10 minutes later. The Renilla expression is divided by the firefly expression to calculate the relative expression. The relative expression is then normalized to the expression of cells that were transfected with a control miRNA that targets eGFP. The DUX4 miRNAs miDUX4.405 and miDUX4.1155 are the most effective at reducing luciferase protein expression in transfected cells. The de-targeted miDUX4 transcripts are destroyed by mir-122 and mir-208 RISC complexes in the liver and heart, respectively, using the DUX4-luciferase target described below in Example 1.

EXAMPLE 3

Production of rAAV Encoding DUX4 MicroRNAs

Vector is produced by co-transfection in HEK293 cells of three plasmids (pAdhelper, AAV helper, and the rAAV genome containing miDUX4; described in detail below), followed by cell-harvesting, vector purification, titration, and quality control assays.

Plasmids: pAdhelper contains the adenovirus genes E2A, E4 ORF6, and VA I/II; AAV helper plasmids contain AAV rep2 and cap6 (for example, for an AAV serotype 6 preparation, the capsid gene would be called cap6); the rAAV plasmid contains AAV inverted terminal repeat (ITRs) sequences flanking the genetic elements to be packaged into the vector. For the AAV.miDUX4, this includes the U6.miDUX4 cloned upstream of the CMV.eGFP reporter gene.

Transfection: Plasmids are transfected into 293 cells (Corning 10-Stack) using $CaPO_4$ at a 4:4:1 ratio (20 μg pAd helper: 20 μg AAV helper: 5 ug rAAV vector plasmid per plate.

Cell harvesting: Forty-eight hr post-transfection, cells are harvested and resuspended in 20 mM Tris (pH 8.0), 1 mM $MgCl_2$ and 150 mM NaCl (T20M1N150) at a density of $5 \times 10^6$ cells/ml. Cells are lysed by four sequential freeze/thaw cycles and Benzonase nuclease (AIC, Stock: 250 U/μl) added to a final concentration of 90 U/ml before cell lysate clarification.

Vector Purification and Titration: Clarified lysates are subjected to iodixanol step gradient purification as previously described (Xiao, X, et al. J. Virol 72:2224-32). The 40% iodixanol layer (containing rAAV) is diluted 5-fold with a no-salt dilution buffer (pH varying depending on serotype) and applied to a Hi-Trap HP-Q/S column. Upon elution with a NaCl salt gradient, peak 1 ml fractions (typically 3-5) are pooled, dialyzed with T20M1N200 (pH 8.0), then sterile filtered and supplemented with 0.001% Pluronic F68. Vectors are stored at −80° C. Purified virus was titered for vg using Q-PCR as previously described (Schnepp and Clark, *Methods Mol. Med.*, 69:427-443 (2002)).

SEQUENCE LISTING (10974 sequences)

SEQ ID NO: 1 - DNA, 86 bp, Homo sapiens
  misc_feature: miDUX4-1
ctcgagtgagcgatccaggattcagatctggtttctgtaaagccacagatgggaaaccagatctgaatcctggactgcctactagt

SEQ ID NO: 2 - DNA, 86 bp, Homo sapiens
  misc_feature: miDUX4-2
ctcgagtgagcgacaggcgcaacctctcctagaactgtaaagccacagatgggttctaggagaggttgcgcctgctgcctactagt

SEQ ID NO: 3 - DNA, 306 bp, Artificial Sequence
  Synthetic polynucleotide
  misc_feature: w.t. U6 promoter
acgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccctcgag

SEQ ID NO: 4 - DNA, 309 bp, Artificial Sequence
  Synthetic polynucleotide
  misc_feature: weakened U6 promoter
acgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatggttaccgtaaggaaaacaaatgatttcgatttcttggctttatatatcttgtggaaaggacgaaacaccctcgag

SEQ ID NO: 5 - DNA, 23 bp, Artificial Sequence
  Synthetic primer
  misc_feature: miRNA 122 binding site
tatttagtgtgataatggtgttt

SEQ ID NO: 6 - DNA, 22 bp, Artificial Sequence
  Synthetic primer
  misc_feature: miRNA 208 binding site
acgagccttttgctcgtcttat

SEQ ID NO: 7 - DNA, 1617 bp, Homo sapiens
  misc_feature: human DUX4
ccaccccccccccccaccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 8 - RNA, 86 nt, Artificial Sequence
  Synthetic Polynucleotide
  misc_feature: miDUX4.405
cucgagugagcgauccaggauucagaucugguuucuguaaagccacagaugggaaaccagaucugaauccuggacugccuacuagu

SEQ ID NO: 9 - RNA, 86 nt, Homo sapiens
  misc_feature: miDUX4.1156
cucgagugagcgacaggcgcaaccucuccuagaacuguaaagccacagauggguucuaggagagguugcgccugcugccuacuagu

SEQ ID NO: 10 - RNA, 19 nt, Homo sapiens
gagauguaacucuaaucca

SEQ ID NO: 11 - RNA, 19 nt, Homo sapiens
agauguaacucuaauccag

SEQ ID NO: 12 - RNA, 19 nt, Homo sapiens
gauguaacucuaauccagg

SEQ ID NO: 13 - RNA, 19 nt, Homo sapiens
auguaacucuaauccaggu

SEQ ID NO: 14 - RNA, 19 nt, Homo sapiens
uguaacucuaauccagguu

SEQ ID NO: 15 - RNA, 19 nt, Homo sapiens
guaacucuaauccagguuu

SEQ ID NO: 16 - RNA, 19 nt, Homo sapiens
uaacucuaauccagguuug

SEQ ID NO: 17 - RNA, 19 nt, Homo sapiens
aacucuaauccagguuugc

SEQ ID NO: 18 - RNA, 19 nt, Homo sapiens
acucuaauccagguuugcc

SEQ ID NO: 19 - RNA, 19 nt, Homo sapiens
cucuaauccagguuugccu

SEQ ID NO: 20 - RNA, 19 nt, Homo sapiens
ucuaauccagguuugccua

SEQ ID NO: 21 - RNA, 19 nt, Homo sapiens
cuaauccagguuugccuag

SEQ ID NO: 22 - RNA, 19 nt, Homo sapiens
uaauccagguuugccuaga

SEQ ID NO: 23 - RNA, 19 nt, Homo sapiens
aauccagguuugccuagac

SEQ ID NO: 24 - RNA, 19 nt, Homo sapiens
auccagguuugccuagaca

SEQ ID NO: 25 - RNA, 19 nt, Homo sapiens
uccagguuugccuagacag

SEQ ID NO: 26 - RNA, 19 nt, Homo sapiens
ccagguuugccuagacagc

SEQ ID NO: 27 - RNA, 19 nt, Homo sapiens
cagguuugccuagacagcg

SEQ ID NO: 28 - RNA, 19 nt, Homo sapiens
agguuugccuagacagcgu

SEQ ID NO: 29 - RNA, 19 nt, Homo sapiens
gguuugccuagacagcguc

SEQ ID NO: 30 - RNA, 19 nt, Homo sapiens
guuugccuagacagcgucg

SEQ ID NO: 31 - RNA, 19 nt, Homo sapiens
uuugccuagacagcgucgg

SEQ ID NO: 32 - RNA, 19 nt, Homo sapiens
uugccuagacagcgucgga

SEQ ID NO: 33 - RNA, 19 nt, Homo sapiens
ugccuagacagcgucggaa

SEQ ID NO: 34 - RNA, 19 nt, Homo sapiens
gccuagacagcgucggaag

SEQ ID NO: 35 - RNA, 19 nt, Homo sapiens
ccuagacagcgucggaagg

SEQ ID NO: 36 - RNA, 19 nt, Homo sapiens
cuagacagcgucggaaggu

SEQ ID NO: 37 - RNA, 19 nt, Homo sapiens
uagacagcgucggaaggug

SEQ ID NO: 38 - RNA, 19 nt, Homo sapiens
agacagcgucggaaggugg

SEQ ID NO: 39 - RNA, 19 nt, Homo sapiens
gacagcgucggaagguggg

SEQ ID NO: 40 - RNA, 19 nt, Homo sapiens
acagcgucggaaggugggg

SEQ ID NO: 41 - RNA, 19 nt, Homo sapiens
cagcgucggaagguggggg

SEQ ID NO: 42 - RNA, 19 nt, Homo sapiens
agcgucggaaggugggggg

SEQ ID NO: 43 - RNA, 19 nt, Homo sapiens
gcgucggaaggugggggga

SEQ ID NO: 44 - RNA, 19 nt, Homo sapiens
cgucggaagguggggggag

SEQ ID NO: 45 - RNA, 19 nt, Homo sapiens
gucggaagguggggggaga

SEQ ID NO: 46 - RNA, 19 nt, Homo sapiens
ucggaagguggggggagac

SEQ ID NO: 47 - RNA, 19 nt, Homo sapiens
cggaagguggggggagaca

SEQ ID NO: 48 - RNA, 19 nt, Homo sapiens
ggaagguggggggagacau

SEQ ID NO: 49 - RNA, 19 nt, Homo sapiens
gaagguggggggagacauu

SEQ ID NO: 50 - RNA, 19 nt, Homo sapiens
aagguggggggagacauuc

SEQ ID NO: 51 - RNA, 19 nt, Homo sapiens
agguggggggagacauuca

SEQ ID NO: 52 - RNA, 19 nt, Homo sapiens
gguggggggagacauucag

SEQ ID NO: 53 - RNA, 19 nt, Homo sapiens
guggggggagacauucagc

SEQ ID NO: 54 - RNA, 19 nt, Homo sapiens
uggggggagacauucagcc

SEQ ID NO: 55 - RNA, 19 nt, Homo sapiens
ggggggagacauucagcca

SEQ ID NO: 56 - RNA, 19 nt, Homo sapiens
gggggagacauucagccag

SEQ ID NO: 57 - RNA, 19 nt, Homo sapiens
ggggagacauucagccaga

SEQ ID NO: 58 - RNA, 19 nt, Homo sapiens
gggagacauucagccagaa

SEQ ID NO: 59 - RNA, 19 nt, Homo sapiens
ggagacauucagccagaau

SEQ ID NO: 60 - RNA, 19 nt, Homo sapiens
gagacauucagccagaauu

SEQ ID NO: 61 - RNA, 19 nt, Homo sapiens
agacauucagccagaauuu

SEQ ID NO: 62 - RNA, 19 nt, Homo sapiens
gacauucagccagaauuuc

SEQ ID NO: 63 - RNA, 19 nt, Homo sapiens
acauucagccagaauuuca

SEQ ID NO: 64 - RNA, 19 nt, Homo sapiens
cauucagccagaauuucac

SEQ ID NO: 65 - RNA, 19 nt, Homo sapiens
auucagccagaauuucacg

SEQ ID NO: 66 - RNA, 19 nt, Homo sapiens
uucagccagaauuucacgg

SEQ ID NO: 67 - RNA, 19 nt, Homo sapiens
ucagccagaauuucacgga

SEQ ID NO: 68 - RNA, 19 nt, Homo sapiens
cagccagaauuucacggaa

SEQ ID NO: 69 - RNA, 19 nt, Homo sapiens
agccagaauuucacggaag

SEQ ID NO: 70 - RNA, 19 nt, Homo sapiens
gccagaauuucacggaaga

SEQ ID NO: 71 - RNA, 19 nt, Homo sapiens
ccagaauuucacggaagaa

SEQ ID NO: 72 - RNA, 19 nt, Homo sapiens
cagaauuucacggaagaac

SEQ ID NO: 73 - RNA, 19 nt, Homo sapiens
agaauuucacggaagaaca

SEQ ID NO: 74 - RNA, 19 nt, Homo sapiens
gaauuucacggaagaacaa

SEQ ID NO: 75 - RNA, 19 nt, Homo sapiens
aauuucacggaagaacaag

SEQ ID NO: 76 - RNA, 19 nt, Homo sapiens
auuucacggaagaacaagg

SEQ ID NO: 77 - RNA, 19 nt, Homo sapiens
uuucacggaagaacaaggg

SEQ ID NO: 78 - RNA, 19 nt, Homo sapiens
uucacggaagaacaagggc

SEQ ID NO: 79 - RNA, 19 nt, Homo sapiens
ucacggaagaacaagggca

SEQ ID NO: 80 - RNA, 19 nt, Homo sapiens
cacggaagaacaagggcac

SEQ ID NO: 81 - RNA, 19 nt, Homo sapiens
acggaagaacaagggcaca

SEQ ID NO: 82 - RNA, 19 nt, Homo sapiens
cggaagaacaagggcacag

SEQ ID NO: 83 - RNA, 19 nt, Homo sapiens
ggaagaacaagggcacaga

SEQ ID NO: 84 - RNA, 19 nt, Homo sapiens
gaagaacaagggcacagag

SEQ ID NO: 85 - RNA, 19 nt, Homo sapiens
aagaacaagggcacagaga

SEQ ID NO: 86 - RNA, 19 nt, Homo sapiens
agaacaagggcacagagag

SEQ ID NO: 87 - RNA, 19 nt, Homo sapiens
gaacaagggcacagagagg

SEQ ID NO: 88 - RNA, 19 nt, Homo sapiens
aacaagggcacagagaggc

SEQ ID NO: 89 - RNA, 19 nt, Homo sapiens
acaagggcacagagaggcc

SEQ ID NO: 90 - RNA, 19 nt, Homo sapiens
caagggcacagagaggcca

SEQ ID NO: 91 - RNA, 19 nt, Homo sapiens
aagggcacagagaggccag

SEQ ID NO: 92 - RNA, 19 nt, Homo sapiens
agggcacagagaggccagc

SEQ ID NO: 93 - RNA, 19 nt, Homo sapiens
gggcacagagaggccagcg

SEQ ID NO: 94 - RNA, 19 nt, Homo sapiens
ggcacagagaggccagcga

SEQ ID NO: 95 - RNA, 19 nt, Homo sapiens
gcacagagaggccagcgag

SEQ ID NO: 96 - RNA, 19 nt, Homo sapiens
cacagagaggccagcgagc

SEQ ID NO: 97 - RNA, 19 nt, Homo sapiens
acagagaggccagcgagcu

SEQ ID NO: 98 - RNA, 19 nt, Homo sapiens
cagagaggccagcgagcuc

SEQ ID NO: 99 - RNA, 19 nt, Homo sapiens
agagaggccagcgagcucc

SEQ ID NO: 100 - RNA, 19 nt, Homo sapiens
gagaggccagcgagcuccc

SEQ ID NO: 101 - RNA, 19 nt, Homo sapiens
agaggccagcgagcucccu

SEQ ID NO: 102 - RNA, 19 nt, Homo sapiens
gaggccagcgagcucccuu

SEQ ID NO: 103 - RNA, 19 nt, Homo sapiens
aggccagcgagcucccuug

SEQ ID NO: 104 - RNA, 19 nt, Homo sapiens
ggccagcgagcucccuugc

SEQ ID NO: 105 - RNA, 19 nt, Homo sapiens
gccagcgagcucccuugca

SEQ ID NO: 106 - RNA, 19 nt, Homo sapiens
ccagcgagcucccuugcac

SEQ ID NO: 107 - RNA, 19 nt, Homo sapiens
cagcgagcucccuugcacg

SEQ ID NO: 108 - RNA, 19 nt, Homo sapiens
agcgagcucccuugcacgu

SEQ ID NO: 109 - RNA, 19 nt, Homo sapiens
gcgagcucccuugcacguc

SEQ ID NO: 110 - RNA, 19 nt, Homo sapiens
cgagcucccuugcacguca

SEQ ID NO: 111 - RNA, 19 nt, Homo sapiens
gagcucccuugcacgucag

SEQ ID NO: 112 - RNA, 19 nt, Homo sapiens
agcucccuugcacgucagc

SEQ ID NO: 113 - RNA, 19 nt, Homo sapiens
gcucccuugcacgucagcc

SEQ ID NO: 114 - RNA, 19 nt, Homo sapiens
cucccuugcacgucagccg

SEQ ID NO: 115 - RNA, 19 nt, Homo sapiens
ucccuugcacgucagccgg

SEQ ID NO: 116 - RNA, 19 nt, Homo sapiens
cccuugcacgucagccggg

SEQ ID NO: 117 - RNA, 19 nt, Homo sapiens
ccuugcacgucagccgggg

SEQ ID NO: 118 - RNA, 19 nt, Homo sapiens
cuugcacgucagccggggu

SEQ ID NO: 119 - RNA, 19 nt, Homo sapiens
uugcacgucagccggggug

SEQ ID NO: 120 - RNA, 19 nt, Homo sapiens
ugcacgucagccggggugc

SEQ ID NO: 121 - RNA, 19 nt, Homo sapiens
gcacgucagccggggugcg

SEQ ID NO: 122 - RNA, 19 nt, Homo sapiens
cacgucagccggggugcgc

SEQ ID NO: 123 - RNA, 19 nt, Homo sapiens
acgucagccggggugcgca

SEQ ID NO: 124 - RNA, 19 nt, Homo sapiens
cgucagccggggugcgcac

SEQ ID NO: 125 - RNA, 19 nt, Homo sapiens
gucagccggggugcgcacu

SEQ ID NO: 126 - RNA, 19 nt, Homo sapiens
ucagccggggugcgcacug

SEQ ID NO: 127 - RNA, 19 nt, Homo sapiens
cagccggggugcgcacugc

SEQ ID NO: 128 - RNA, 19 nt, Homo sapiens
agccggggugcgcacugcg

SEQ ID NO: 129 - RNA, 19 nt, Homo sapiens
gccggggugcgcacugcgc

SEQ ID NO: 130 - RNA, 19 nt, Homo sapiens
ccggggugcgcacugcgcg

SEQ ID NO: 131 - RNA, 19 nt, Homo sapiens
cggggugcgcacugcgcgc

SEQ ID NO: 132 - RNA, 19 nt, Homo sapiens
ggggugcgcacugcgcgca

SEQ ID NO: 133 - RNA, 19 nt, Homo sapiens
gggugcgcacugcgcgcag

SEQ ID NO: 134 - RNA, 19 nt, Homo sapiens
ggugcgcacugcgcgcagg

SEQ ID NO: 135 - RNA, 19 nt, Homo sapiens
gugcgcacugcgcgcaggu

SEQ ID NO: 136 - RNA, 19 nt, Homo sapiens
ugcgcacugcgcgcagguc

SEQ ID NO: 137 - RNA, 19 nt, Homo sapiens
gcgcacugcgcgcaggucu

SEQ ID NO: 138 - RNA, 19 nt, Homo sapiens
cgcacugcgcgcaggucua

SEQ ID NO: 139 - RNA, 19 nt, Homo sapiens
gcacugcgcgcaggucuag

SEQ ID NO: 140 - RNA, 19 nt, Homo sapiens
cacugcgcgcaggucuagc

SEQ ID NO: 141 - RNA, 19 nt, Homo sapiens
acugcgcgcaggucuagcc

SEQ ID NO: 142 - RNA, 19 nt, Homo sapiens
cugcgcgcaggucuagcca

SEQ ID NO: 143 - RNA, 19 nt, Homo sapiens
ugcgcgcaggucuagccag

SEQ ID NO: 144 - RNA, 19 nt, Homo sapiens
gcgcgcaggucuagccagg

SEQ ID NO: 145 - RNA, 19 nt, Homo sapiens
cgcgcaggucuagccagga

SEQ ID NO: 146 - RNA, 19 nt, Homo sapiens
gcgcaggucuagccaggaa

SEQ ID NO: 147 - RNA, 19 nt, Homo sapiens
cgcaggucuagccaggaag

SEQ ID NO: 148 - RNA, 19 nt, Homo sapiens
gcaggucuagccaggaagc

SEQ ID NO: 149 - RNA, 19 nt, Homo sapiens
caggucuagccaggaagcg

SEQ ID NO: 150 - RNA, 19 nt, Homo sapiens
aggucuagccaggaagcgg

SEQ ID NO: 151 - RNA, 19 nt, Homo sapiens
ggucuagccaggaagcggg

SEQ ID NO: 152 - RNA, 19 nt, Homo sapiens
gucuagccaggaagcgggc

SEQ ID NO: 153 - RNA, 19 nt, Homo sapiens
ucuagccaggaagcgggca

SEQ ID NO: 154 - RNA, 19 nt, Homo sapiens
cuagccaggaagcgggcaa

SEQ ID NO: 155 - RNA, 19 nt, Homo sapiens
uagccaggaagcgggcaaa

SEQ ID NO: 156 - RNA, 19 nt, Homo sapiens
agccaggaagcgggcaaag

SEQ ID NO: 157 - RNA, 19 nt, Homo sapiens
gccaggaagcgggcaaaga

SEQ ID NO: 158 - RNA, 19 nt, Homo sapiens
ccaggaagcgggcaaagac

SEQ ID NO: 159 - RNA, 19 nt, Homo sapiens
caggaagcgggcaaagaca

SEQ ID NO: 160 - RNA, 19 nt, Homo sapiens
aggaagcgggcaaagacag

SEQ ID NO: 161 - RNA, 19 nt, Homo sapiens
ggaagcgggcaaagacaga

SEQ ID NO: 162 - RNA, 19 nt, Homo sapiens
gaagcgggcaaagacagac

SEQ ID NO: 163 - RNA, 19 nt, Homo sapiens
aagcgggcaaagacagaca

SEQ ID NO: 164 - RNA, 19 nt, Homo sapiens
agcgggcaaagacagacag

SEQ ID NO: 165 - RNA, 19 nt, Homo sapiens
gcgggcaaagacagacaga

SEQ ID NO: 166 - RNA, 19 nt, Homo sapiens
cgggcaaagacagacagag

SEQ ID NO: 167 - RNA, 19 nt, Homo sapiens
gggcaaagacagacagagg

SEQ ID NO: 168 - RNA, 19 nt, Homo sapiens
ggcaaagacagacagaggu

SEQ ID NO: 169 - RNA, 19 nt, Homo sapiens
gcaaagacagacagaggua

SEQ ID NO: 170 - RNA, 19 nt, Homo sapiens
caaagacagacagagguau

SEQ ID NO: 171 - RNA, 19 nt, Homo sapiens
aaagacagacagagguaug

SEQ ID NO: 172 - RNA, 19 nt, Homo sapiens
aagacagacagagguaugc

SEQ ID NO: 173 - RNA, 19 nt, Homo sapiens
agacagacagagguaugcu

SEQ ID NO: 174 - RNA, 19 nt, Homo sapiens
gacagacagagguaugcuu

SEQ ID NO: 175 - RNA, 19 nt, Homo sapiens
acagacagagguaugcuuu

SEQ ID NO: 176 - RNA, 19 nt, Homo sapiens
cagacagagguaugcuuuu

SEQ ID NO: 177 - RNA, 19 nt, Homo sapiens
agacagagguaugcuuuug

SEQ ID NO: 178 - RNA, 19 nt, Homo sapiens
gacagagguaugcuuuuga

SEQ ID NO: 179 - RNA, 19 nt, Homo sapiens
acagagguaugcuuuugac

SEQ ID NO: 180 - RNA, 19 nt, Homo sapiens
cagagguaugcuuuugacc

SEQ ID NO: 181 - RNA, 19 nt, Homo sapiens
agagguaugcuuuugaccg

SEQ ID NO: 182 - RNA, 19 nt, Homo sapiens
gagguaugcuuuugaccgc

SEQ ID NO: 183 - RNA, 19 nt, Homo sapiens
agguaugcuuuugaccgcc

SEQ ID NO: 184 - RNA, 19 nt, Homo sapiens
gguaugcuuuugaccgcca

SEQ ID NO: 185 - RNA, 19 nt, Homo sapiens
guaugcuuuugaccgccag

SEQ ID NO: 186 - RNA, 19 nt, Homo sapiens
uaugcuuuugaccgccagg

SEQ ID NO: 187 - RNA, 19 nt, Homo sapiens
augcuuuugaccgccagga

SEQ ID NO: 188 - RNA, 19 nt, Homo sapiens
ugcuuuugaccgccaggag

SEQ ID NO: 189 - RNA, 19 nt, Homo sapiens
gcuuuugaccgccaggagc

SEQ ID NO: 190 - RNA, 19 nt, Homo sapiens
cuuuugaccgccaggagcu

SEQ ID NO: 191 - RNA, 19 nt, Homo sapiens
uuuugaccgccaggagcuc

SEQ ID NO: 192 - RNA, 19 nt, Homo sapiens
uuugaccgccaggagcucc

SEQ ID NO: 193 - RNA, 19 nt, Homo sapiens
uugaccgccaggagcuccg

SEQ ID NO: 194 - RNA, 19 nt, Homo sapiens
ugaccgccaggagcuccgc

SEQ ID NO: 195 - RNA, 19 nt, Homo sapiens
gaccgccaggagcuccgcg

SEQ ID NO: 196 - RNA, 19 nt, Homo sapiens
accgccaggagcuccgcgc

SEQ ID NO: 197 - RNA, 19 nt, Homo sapiens
ccgccaggagcuccgcgcu

SEQ ID NO: 198 - RNA, 19 nt, Homo sapiens
cgccaggagcuccgcgcug

SEQ ID NO: 199 - RNA, 19 nt, Homo sapiens
gccaggagcuccgcgcugg

SEQ ID NO: 200 - RNA, 19 nt, Homo sapiens
ccaggagcuccgcgcuggc

SEQ ID NO: 201 - RNA, 19 nt, Homo sapiens
caggagcuccgcgcuggca

SEQ ID NO: 202 - RNA, 19 nt, Homo sapiens
aggagcuccgcgcuggcag

SEQ ID NO: 203 - RNA, 19 nt, Homo sapiens
ggagcuccgcgcuggcagc

SEQ ID NO: 204 - RNA, 19 nt, Homo sapiens
gagcuccgcgcuggcagcu

SEQ ID NO: 205 - RNA, 19 nt, Homo sapiens
agcuccgcgcuggcagcug

SEQ ID NO: 206 - RNA, 19 nt, Homo sapiens
gcuccgcgcuggcagcugg

SEQ ID NO: 207 - RNA, 19 nt, Homo sapiens
cuccgcgcuggcagcuggg

SEQ ID NO: 208 - RNA, 19 nt, Homo sapiens
uccgcgcuggcagcuggga

SEQ ID NO: 209 - RNA, 19 nt, Homo sapiens
ccgcgcuggcagcugggag

SEQ ID NO: 210 - RNA, 19 nt, Homo sapiens
cgcgcuggcagcugggagg

SEQ ID NO: 211 - RNA, 19 nt, Homo sapiens
gcgcuggcagcugggaggc

SEQ ID NO: 212 - RNA, 19 nt, Homo sapiens
cgcuggcagcugggaggcu

SEQ ID NO: 213 - RNA, 19 nt, Homo sapiens
gcuggcagcugggaggcug

SEQ ID NO: 214 - RNA, 19 nt, Homo sapiens
cuggcagcugggaggcugc

SEQ ID NO: 215 - RNA, 19 nt, Homo sapiens
uggcagcugggaggcugca

SEQ ID NO: 216 - RNA, 19 nt, Homo sapiens
ggcagcugggaggcugcag

SEQ ID NO: 217 - RNA, 19 nt, Homo sapiens
gcagcugggaggcugcagg

SEQ ID NO: 218 - RNA, 19 nt, Homo sapiens
cagcugggaggcugcaggg

SEQ ID NO: 219 - RNA, 19 nt, Homo sapiens
agcugggaggcugcagggg

SEQ ID NO: 220 - RNA, 19 nt, Homo sapiens
gcugggaggcugcaggggc

SEQ ID NO: 221 - RNA, 19 nt, Homo sapiens
cugggaggcugcaggggcc

SEQ ID NO: 222 - RNA, 19 nt, Homo sapiens
ugggaggcugcaggggccc

SEQ ID NO: 223 - RNA, 19 nt, Homo sapiens
gggaggcugcaggggcccg

SEQ ID NO: 224 - RNA, 19 nt, Homo sapiens
ggaggcugcaggggcccgg

SEQ ID NO: 225 - RNA, 19 nt, Homo sapiens
gaggcugcaggggcccggg

SEQ ID NO: 226 - RNA, 19 nt, Homo sapiens
aggcugcaggggcccgggc

SEQ ID NO: 227 - RNA, 19 nt, Homo sapiens
ggcugcaggggcccgggcg

SEQ ID NO: 228 - RNA, 19 nt, Homo sapiens
gcugcaggggcccgggcgg

SEQ ID NO: 229 - RNA, 19 nt, Homo sapiens
cugcaggggcccgggcggg

SEQ ID NO: 230 - RNA, 19 nt, Homo sapiens
ugcaggggcccgggcgggc

SEQ ID NO: 231 - RNA, 19 nt, Homo sapiens
gcaggggcccgggcgggcg

SEQ ID NO: 232 - RNA, 19 nt, Homo sapiens
caggggcccgggcgggcgg

SEQ ID NO: 233 - RNA, 19 nt, Homo sapiens
aggggcccgggcgggcggg

SEQ ID NO: 234 - RNA, 19 nt, Homo sapiens
ggggcccgggcgggcgggc

SEQ ID NO: 235 - RNA, 19 nt, Homo sapiens
gggcccgggcgggcgggcg

SEQ ID NO: 236 - RNA, 19 nt, Homo sapiens
ggcccgggcgggcgggcga

SEQ ID NO: 237 - RNA, 19 nt, Homo sapiens
gcccgggcgggcgggcgac

SEQ ID NO: 238 - RNA, 19 nt, Homo sapiens
cccgggcgggcgggcgacg

SEQ ID NO: 239 - RNA, 19 nt, Homo sapiens
ccgggcgggcgggcgacgg

SEQ ID NO: 240 - RNA, 19 nt, Homo sapiens
cgggcgggcgggcgacggu

SEQ ID NO: 241 - RNA, 19 nt, Homo sapiens
gggcgggcgggcgacggug

SEQ ID NO: 242 - RNA, 19 nt, Homo sapiens
ggcgggcgggcgacggugg

SEQ ID NO: 243 - RNA, 19 nt, Homo sapiens
gcgggcgggcgacgguggc

SEQ ID NO: 244 - RNA, 19 nt, Homo sapiens
cgggcgggcgacgguggcg

SEQ ID NO: 245 - RNA, 19 nt, Homo sapiens
gggcgggcgacgguggcgc

SEQ ID NO: 246 - RNA, 19 nt, Homo sapiens
ggcgggcgacgguggcgcg

SEQ ID NO: 247 - RNA, 19 nt, Homo sapiens
gcgggcgacgguggcgcgg

SEQ ID NO: 248 - RNA, 19 nt, Homo sapiens
cgggcgacgguggcgcggg

SEQ ID NO: 249 - RNA, 19 nt, Homo sapiens
gggcgacgguggcgcgggg

SEQ ID NO: 250 - RNA, 19 nt, Homo sapiens
ggcgacgguggcgcggggg

SEQ ID NO: 251 - RNA, 19 nt, Homo sapiens
gcgacgguggcgcgggggc

SEQ ID NO: 252 - RNA, 19 nt, Homo sapiens
cgacgguggcgcgggggca

SEQ ID NO: 253 - RNA, 19 nt, Homo sapiens
gacgguggcgcgggggcac

SEQ ID NO: 254 - RNA, 19 nt, Homo sapiens
acgguggcgcgggggcaca

SEQ ID NO: 255 - RNA, 19 nt, Homo sapiens
cgguggcgcgggggcacac

SEQ ID NO: 256 - RNA, 19 nt, Homo sapiens
gguggcgcgggggcacaca

SEQ ID NO: 257 - RNA, 19 nt, Homo sapiens
guggcgcgggggcacacag

SEQ ID NO: 258 - RNA, 19 nt, Homo sapiens
uggcgcgggggcacacagg

SEQ ID NO: 259 - RNA, 19 nt, Homo sapiens
ggcgcgggggcacacagga

SEQ ID NO: 260 - RNA, 19 nt, Homo sapiens
gcgcgggggcacacaggag

SEQ ID NO: 261 - RNA, 19 nt, Homo sapiens
cgcgggggcacacaggagg

SEQ ID NO: 262 - RNA, 19 nt, Homo sapiens
gcgggggcacacaggaggc

SEQ ID NO: 263 - RNA, 19 nt, Homo sapiens
cgggggcacacaggaggcg

SEQ ID NO: 264 - RNA, 19 nt, Homo sapiens
gggggcacacaggaggcga

SEQ ID NO: 265 - RNA, 19 nt, Homo sapiens
ggggcacacaggaggcgag

SEQ ID NO: 266 - RNA, 19 nt, Homo sapiens
gggcacacaggaggcgagc

SEQ ID NO: 267 - RNA, 19 nt, Homo sapiens
ggcacacaggaggcgagcc

SEQ ID NO: 268 - RNA, 19 nt, Homo sapiens
gcacacaggaggcgagccg

SEQ ID NO: 269 - RNA, 19 nt, Homo sapiens
cacacaggaggcgagccgc

SEQ ID NO: 270 - RNA, 19 nt, Homo sapiens
acacaggaggcgagccgcc

SEQ ID NO: 271 - RNA, 19 nt, Homo sapiens
cacaggaggcgagccgccg

SEQ ID NO: 272 - RNA, 19 nt, Homo sapiens
acaggaggcgagccgccgg

SEQ ID NO: 273 - RNA, 19 nt, Homo sapiens
caggaggcgagccgccgga

SEQ ID NO: 274 - RNA, 19 nt, Homo sapiens
aggaggcgagccgccggag

SEQ ID NO: 275 - RNA, 19 nt, Homo sapiens
ggaggcgagccgccggagc

SEQ ID NO: 276 - RNA, 19 nt, Homo sapiens
gaggcgagccgccggagcg

SEQ ID NO: 277 - RNA, 19 nt, Homo sapiens
aggcgagccgccggagcgg

SEQ ID NO: 278 - RNA, 19 nt, Homo sapiens
ggcgagccgccggagcgga

SEQ ID NO: 279 - RNA, 19 nt, Homo sapiens
gcgagccgccggagcggag

SEQ ID NO: 280 - RNA, 19 nt, Homo sapiens
cgagccgccggagcggagu

SEQ ID NO: 281 - RNA, 19 nt, Homo sapiens
gagccgccggagcggaguc

SEQ ID NO: 282 - RNA, 19 nt, Homo sapiens
agccgccggagcggaguca

SEQ ID NO: 283 - RNA, 19 nt, Homo sapiens
gccgccggagcggagucag

SEQ ID NO: 284 - RNA, 19 nt, Homo sapiens
ccgccggagcggagucagg

SEQ ID NO: 285 - RNA, 19 nt, Homo sapiens
cgccggagcggagucaggc

SEQ ID NO: 286 - RNA, 19 nt, Homo sapiens
gccggagcggagucaggcc

SEQ ID NO: 287 - RNA, 19 nt, Homo sapiens
ccggagcggagucaggccc

SEQ ID NO: 288 - RNA, 19 nt, Homo sapiens
cggagcggagucaggcccg

SEQ ID NO: 289 - RNA, 19 nt, Homo sapiens
ggagcggagucaggcccgg

SEQ ID NO: 290 - RNA, 19 nt, Homo sapiens
gagcggagucaggcccgga

SEQ ID NO: 291 - RNA, 19 nt, Homo sapiens
agcggagucaggcccggac

SEQ ID NO: 292 - RNA, 19 nt, Homo sapiens
gcggagucaggcccggacg

SEQ ID NO: 293 - RNA, 19 nt, Homo sapiens
cggagucaggcccggacgc

SEQ ID NO: 294 - RNA, 19 nt, Homo sapiens
ggagucaggcccggacgcu

SEQ ID NO: 295 - RNA, 19 nt, Homo sapiens
gagucaggcccggacgcug

SEQ ID NO: 296 - RNA, 19 nt, Homo sapiens
agucaggcccggacgcugc

SEQ ID NO: 297 - RNA, 19 nt, Homo sapiens
gucaggcccggacgcugcg

SEQ ID NO: 298 - RNA, 19 nt, Homo sapiens
ucaggcccggacgcugcgc

SEQ ID NO: 299 - RNA, 19 nt, Homo sapiens
caggcccggacgcugcgcg

SEQ ID NO: 300 - RNA, 19 nt, Homo sapiens
aggcccggacgcugcgcgg

SEQ ID NO: 301 - RNA, 19 nt, Homo sapiens
ggcccggacgcugcgcggg

SEQ ID NO: 302 - RNA, 19 nt, Homo sapiens
gcccggacgcugcgcgggg

SEQ ID NO: 303 - RNA, 19 nt, Homo sapiens
cccggacgcugcgcggggc

SEQ ID NO: 304 - RNA, 19 nt, Homo sapiens
ccggacgcugcgcggggcc

SEQ ID NO: 305 - RNA, 19 nt, Homo sapiens
cggacgcugcgcggggccc

SEQ ID NO: 306 - RNA, 19 nt, Homo sapiens
ggacgcugcgcggggcccg

SEQ ID NO: 307 - RNA, 19 nt, Homo sapiens
gacgcugcgcggggcccgg

SEQ ID NO: 308 - RNA, 19 nt, Homo sapiens
acgcugcgcggggcccggu

SEQ ID NO: 309 - RNA, 19 nt, Homo sapiens
cgcugcgcggggcccggug

SEQ ID NO: 310 - RNA, 19 nt, Homo sapiens
gcugcgcggggcccggugu

SEQ ID NO: 311 - RNA, 19 nt, Homo sapiens
cugcgcggggcccgguguu

SEQ ID NO: 312 - RNA, 19 nt, Homo sapiens
ugcgcggggcccgguguuu

SEQ ID NO: 313 - RNA, 19 nt, Homo sapiens
gcgcggggcccgguguuuc

SEQ ID NO: 314 - RNA, 19 nt, Homo sapiens
cgcggggcccgguguuucg

SEQ ID NO: 315 - RNA, 19 nt, Homo sapiens
gcggggcccgguguuucgc

SEQ ID NO: 316 - RNA, 19 nt, Homo sapiens
cggggcccgguguuucgcg

SEQ ID NO: 317 - RNA, 19 nt, Homo sapiens
ggggcccgguguuucgcgg

SEQ ID NO: 318 - RNA, 19 nt, Homo sapiens
gggcccgguguuucgcggg

SEQ ID NO: 319 - RNA, 19 nt, Homo sapiens
ggcccgguguuucgcggga

SEQ ID NO: 320 - RNA, 19 nt, Homo sapiens
gcccgguguuucgcgggac

SEQ ID NO: 321 - RNA, 19 nt, Homo sapiens
cccgguguuucgcgggacg

SEQ ID NO: 322 - RNA, 19 nt, Homo sapiens
ccgguguuucgcgggacgg

SEQ ID NO: 323 - RNA, 19 nt, Homo sapiens
cgguguuucgcgggacggg

SEQ ID NO: 324 - RNA, 19 nt, Homo sapiens
gguguuucgcgggacgggg

SEQ ID NO: 325 - RNA, 19 nt, Homo sapiens
guguuucgcgggacggggg

SEQ ID NO: 326 - RNA, 19 nt, Homo sapiens
uguuucgcgggacgggggu

SEQ ID NO: 327 - RNA, 19 nt, Homo sapiens
guuucgcgggacggggguc

SEQ ID NO: 328 - RNA, 19 nt, Homo sapiens
uuucgcgggacgggggucu

SEQ ID NO: 329 - RNA, 19 nt, Homo sapiens
uucgcgggacgggggucuc

SEQ ID NO: 330 - RNA, 19 nt, Homo sapiens
ucgcgggacgggggucucc

SEQ ID NO: 331 - RNA, 19 nt, Homo sapiens
cgcgggacgggggucucca

SEQ ID NO: 332 - RNA, 19 nt, Homo sapiens
gcgggacgggggucuccac

SEQ ID NO: 333 - RNA, 19 nt, Homo sapiens
cgggacgggggucuccacc

SEQ ID NO: 334 - RNA, 19 nt, Homo sapiens
gggacgggggucuccaccc

SEQ ID NO: 335 - RNA, 19 nt, Homo sapiens
ggacgggggucuccaccca

SEQ ID NO: 336 - RNA, 19 nt, Homo sapiens
gacgggggucuccacccag

SEQ ID NO: 337 - RNA, 19 nt, Homo sapiens
acgggggucuccacccagc

SEQ ID NO: 338 - RNA, 19 nt, Homo sapiens
cgggggucuccacccagcc

SEQ ID NO: 339 - RNA, 19 nt, Homo sapiens
gggggucuccacccagccc

SEQ ID NO: 340 - RNA, 19 nt, Homo sapiens
ggggucuccacccagccca

SEQ ID NO: 341 - RNA, 19 nt, Homo sapiens
gggucuccacccagcccag

SEQ ID NO: 342 - RNA, 19 nt, Homo sapiens
ggucuccacccagcccagg

SEQ ID NO: 343 - RNA, 19 nt, Homo sapiens
gucuccacccagcccaggg

SEQ ID NO: 344 - RNA, 19 nt, Homo sapiens
ucuccacccagcccagggg

SEQ ID NO: 345 - RNA, 19 nt, Homo sapiens
cuccacccagcccagggga

SEQ ID NO: 346 - RNA, 19 nt, Homo sapiens
uccacccagcccaggggac

SEQ ID NO: 347 - RNA, 19 nt, Homo sapiens
ccacccagcccaggggacg

SEQ ID NO: 348 - RNA, 19 nt, Homo sapiens
cacccagcccaggggacga

SEQ ID NO: 349 - RNA, 19 nt, Homo sapiens
acccagcccaggggacgac

SEQ ID NO: 350 - RNA, 19 nt, Homo sapiens
cccagcccaggggacgacg

SEQ ID NO: 351 - RNA, 19 nt, Homo sapiens
ccagcccaggggacgacgc

SEQ ID NO: 352 - RNA, 19 nt, Homo sapiens
cagcccaggggacgacgcg

SEQ ID NO: 353 - RNA, 19 nt, Homo sapiens
agcccaggggacgacgcgu

SEQ ID NO: 354 - RNA, 19 nt, Homo sapiens
gcccaggggacgacgcguu

SEQ ID NO: 355 - RNA, 19 nt, Homo sapiens
cccaggggacgacgcguuu

SEQ ID NO: 356 - RNA, 19 nt, Homo sapiens
ccaggggacgacgcguuuu

SEQ ID NO: 357 - RNA, 19 nt, Homo sapiens
caggggacgacgcguuuuc

SEQ ID NO: 358 - RNA, 19 nt, Homo sapiens
aggggacgacgcguuuucc

SEQ ID NO: 359 - RNA, 19 nt, Homo sapiens
ggggacgacgcguuuuccg

SEQ ID NO: 360 - RNA, 19 nt, Homo sapiens
gggacgacgcguuuuccgg

SEQ ID NO: 361 - RNA, 19 nt, Homo sapiens
ggacgacgcguuuuccggg

SEQ ID NO: 362 - RNA, 19 nt, Homo sapiens
gacgacgcguuuuccgggg

SEQ ID NO: 363 - RNA, 19 nt, Homo sapiens
acgacgcguuuuccggggg

SEQ ID NO: 364 - RNA, 19 nt, Homo sapiens
cgacgcguuuuccgggggu

SEQ ID NO: 365 - RNA, 19 nt, Homo sapiens
gacgcguuuuccgggggug

SEQ ID NO: 366 - RNA, 19 nt, Homo sapiens
acgcguuuuccgggggugg

SEQ ID NO: 367 - RNA, 19 nt, Homo sapiens
cgcguuuuccggggguggg

SEQ ID NO: 368 - RNA, 19 nt, Homo sapiens
gcguuuuccgggggugggg

SEQ ID NO: 369 - RNA, 19 nt, Homo sapiens
cguuuuccggggguggggg

SEQ ID NO: 370 - RNA, 19 nt, Homo sapiens
guuuuccgggggugggggg

SEQ ID NO: 371 - RNA, 19 nt, Homo sapiens
uuuuccggggguggggggu

SEQ ID NO: 372 - RNA, 19 nt, Homo sapiens
uuuccggggguggggggug

SEQ ID NO: 373 - RNA, 19 nt, Homo sapiens
uuccggggguggggggugg

SEQ ID NO: 374 - RNA, 19 nt, Homo sapiens
uccgggggugggggguggg

SEQ ID NO: 375 - RNA, 19 nt, Homo sapiens
ccggggguggggggugggg

SEQ ID NO: 376 - RNA, 19 nt, Homo sapiens
cgggggugggggguggggg

SEQ ID NO: 377 - RNA, 19 nt, Homo sapiens
ggggguggggggugggggg

SEQ ID NO: 378 - RNA, 19 nt, Homo sapiens
ggggugggggguggggggu

SEQ ID NO: 379 - RNA, 19 nt, Homo sapiens
gggugggggguggggggug

SEQ ID NO: 380 - RNA, 19 nt, Homo sapiens
ggugggggguggggggugg

SEQ ID NO: 381 - RNA, 19 nt, Homo sapiens
guggggggugggggguggg

SEQ ID NO: 382 - RNA, 19 nt, Homo sapiens
ugggggguggggggugggg

SEQ ID NO: 383 - RNA, 19 nt, Homo sapiens
gggggguggggggugggga

SEQ ID NO: 384 - RNA, 19 nt, Homo sapiens
gggggugggggguggggag

SEQ ID NO: 385 - RNA, 19 nt, Homo sapiens
ggggugggggguggggagg

SEQ ID NO: 386 - RNA, 19 nt, Homo sapiens
gggugggggguggggaggg

SEQ ID NO: 387 - RNA, 19 nt, Homo sapiens
ggugggggguggggagggg

SEQ ID NO: 388 - RNA, 19 nt, Homo sapiens
gugggggguggggaggggg

SEQ ID NO: 389 - RNA, 19 nt, Homo sapiens
ugggggguggggagggggc

SEQ ID NO: 390 - RNA, 19 nt, Homo sapiens
gggggguggggagggggcg

SEQ ID NO: 391 - RNA, 19 nt, Homo sapiens
ggggguggggagggggcgg

SEQ ID NO: 392 - RNA, 19 nt, Homo sapiens
gggguggggagggggcggu

SEQ ID NO: 393 - RNA, 19 nt, Homo sapiens
ggguggggagggggcgguc

SEQ ID NO: 394 - RNA, 19 nt, Homo sapiens
gguggggagggggcgguca

SEQ ID NO: 395 - RNA, 19 nt, Homo sapiens
guggggagggggcggucag

SEQ ID NO: 396 - RNA, 19 nt, Homo sapiens
uggggagggggcggucagg

SEQ ID NO: 397 - RNA, 19 nt, Homo sapiens
ggggagggggcggucaggc

SEQ ID NO: 398 - RNA, 19 nt, Homo sapiens
gggagggggcggucaggcg

SEQ ID NO: 399 - RNA, 19 nt, Homo sapiens
ggagggggcggucaggcgg

SEQ ID NO: 400 - RNA, 19 nt, Homo sapiens
gagggggcggucaggcggc

SEQ ID NO: 401 - RNA, 19 nt, Homo sapiens
agggggcggucaggcggcg

SEQ ID NO: 402 - RNA, 19 nt, Homo sapiens
gggggcggucaggcggcgg

SEQ ID NO: 403 - RNA, 19 nt, Homo sapiens
ggggcggucaggcggcggg

SEQ ID NO: 404 - RNA, 19 nt, Homo sapiens
gggcggucaggcggcgggg

SEQ ID NO: 405 - RNA, 19 nt, Homo sapiens
ggcggucaggcggcggggu

SEQ ID NO: 406 - RNA, 19 nt, Homo sapiens
gcggucaggcggcggggug

SEQ ID NO: 407 - RNA, 19 nt, Homo sapiens
cggucaggcggcggggugg

SEQ ID NO: 408 - RNA, 19 nt, Homo sapiens
ggucaggcggcgggguggg

SEQ ID NO: 409 - RNA, 19 nt, Homo sapiens
gucaggcggcggggugggc

SEQ ID NO: 410 - RNA, 19 nt, Homo sapiens
ucaggcggcggggugggcu

SEQ ID NO: 411 - RNA, 19 nt, Homo sapiens
caggcggcggggugggcug

SEQ ID NO: 412 - RNA, 19 nt, Homo sapiens
aggcggcggggugggcugg

SEQ ID NO: 413 - RNA, 19 nt, Homo sapiens
ggcggcggggugggcuggu

SEQ ID NO: 414 - RNA, 19 nt, Homo sapiens
gcggcggggugggcuggug

SEQ ID NO: 415 - RNA, 19 nt, Homo sapiens
cggcggggugggcuggugg

SEQ ID NO: 416 - RNA, 19 nt, Homo sapiens
ggcggggugggcuggugga

SEQ ID NO: 417 - RNA, 19 nt, Homo sapiens
gcggggugggcugguggag

SEQ ID NO: 418 - RNA, 19 nt, Homo sapiens
cggggugggcugguggaga

SEQ ID NO: 419 - RNA, 19 nt, Homo sapiens
ggggugggcugguggagag

SEQ ID NO: 420 - RNA, 19 nt, Homo sapiens
gggugggcugguggagagg

SEQ ID NO: 421 - RNA, 19 nt, Homo sapiens
ggugggcugguggagaggc

SEQ ID NO: 422 - RNA, 19 nt, Homo sapiens
gugggcugguggagaggca

SEQ ID NO: 423 - RNA, 19 nt, Homo sapiens
ugggcugguggagaggcag

SEQ ID NO: 424 - RNA, 19 nt, Homo sapiens
gggcugguggagaggcagg

SEQ ID NO: 425 - RNA, 19 nt, Homo sapiens
ggcugguggagaggcagga

SEQ ID NO: 426 - RNA, 19 nt, Homo sapiens
gcugguggagaggcaggag

SEQ ID NO: 427 - RNA, 19 nt, Homo sapiens
cugguggagaggcaggaga

SEQ ID NO: 428 - RNA, 19 nt, Homo sapiens
ugguggagaggcaggagag

SEQ ID NO: 429 - RNA, 19 nt, Homo sapiens
gguggagaggcaggagagc

SEQ ID NO: 430 - RNA, 19 nt, Homo sapiens
guggagaggcaggagagcu

SEQ ID NO: 431 - RNA, 19 nt, Homo sapiens
uggagaggcaggagagcuc

SEQ ID NO: 432 - RNA, 19 nt, Homo sapiens
ggagaggcaggagagcucu

SEQ ID NO: 433 - RNA, 19 nt, Homo sapiens
gagaggcaggagagcucug

SEQ ID NO: 434 - RNA, 19 nt, Homo sapiens
agaggcaggagagcucugc

SEQ ID NO: 435 - RNA, 19 nt, Homo sapiens
gaggcaggagagcucugcc

SEQ ID NO: 436 - RNA, 19 nt, Homo sapiens
aggcaggagagcucugccc

SEQ ID NO: 437 - RNA, 19 nt, Homo sapiens
ggcaggagagcucugcccg

SEQ ID NO: 438 - RNA, 19 nt, Homo sapiens
gcaggagagcucugcccgg

SEQ ID NO: 439 - RNA, 19 nt, Homo sapiens
caggagagcucugcccggg

SEQ ID NO: 440 - RNA, 19 nt, Homo sapiens
aggagagcucugcccgggc

SEQ ID NO: 441 - RNA, 19 nt, Homo sapiens
ggagagcucugcccgggcu

SEQ ID NO: 442 - RNA, 19 nt, Homo sapiens
gagagcucugcccgggcug

SEQ ID NO: 443 - RNA, 19 nt, Homo sapiens
agagcucugcccgggcugc

SEQ ID NO: 444 - RNA, 19 nt, Homo sapiens
gagcucugcccgggcugcu

SEQ ID NO: 445 - RNA, 19 nt, Homo sapiens
agcucugcccgggcugcuc

SEQ ID NO: 446 - RNA, 19 nt, Homo sapiens
gcucugcccgggcugcucc

SEQ ID NO: 447 - RNA, 19 nt, Homo sapiens
cucugcccgggcugcuccc

SEQ ID NO: 448 - RNA, 19 nt, Homo sapiens
ucugcccgggcugcuccca

SEQ ID NO: 449 - RNA, 19 nt, Homo sapiens
cugcccgggcugcucccac

SEQ ID NO: 450 - RNA, 19 nt, Homo sapiens
ugcccgggcugcucccaca

SEQ ID NO: 451 - RNA, 19 nt, Homo sapiens
gcccgggcugcucccacag

SEQ ID NO: 452 - RNA, 19 nt, Homo sapiens
cccgggcugcucccacagc

SEQ ID NO: 453 - RNA, 19 nt, Homo sapiens
ccgggcugcucccacagcc

SEQ ID NO: 454 - RNA, 19 nt, Homo sapiens
cgggcugcucccacagccc

SEQ ID NO: 455 - RNA, 19 nt, Homo sapiens
gggcugcucccacagccca

SEQ ID NO: 456 - RNA, 19 nt, Homo sapiens
ggcugcucccacagcccag

SEQ ID NO: 457 - RNA, 19 nt, Homo sapiens
gcugcucccacagcccagg

SEQ ID NO: 458 - RNA, 19 nt, Homo sapiens
cugcucccacagcccaggc

SEQ ID NO: 459 - RNA, 19 nt, Homo sapiens
ugcucccacagcccaggcg

SEQ ID NO: 460 - RNA, 19 nt, Homo sapiens
gcucccacagcccaggcgg

SEQ ID NO: 461 - RNA, 19 nt, Homo sapiens
cucccacagcccaggcggc

SEQ ID NO: 462 - RNA, 19 nt, Homo sapiens
ucccacagcccaggcggcu

SEQ ID NO: 463 - RNA, 19 nt, Homo sapiens
cccacagcccaggcggcug

SEQ ID NO: 464 - RNA, 19 nt, Homo sapiens
ccacagcccaggcggcugc

SEQ ID NO: 465 - RNA, 19 nt, Homo sapiens
cacagcccaggcggcugcc

SEQ ID NO: 466 - RNA, 19 nt, Homo sapiens
acagcccaggcggcugccc

SEQ ID NO: 467 - RNA, 19 nt, Homo sapiens
cagcccaggcggcugcccg

SEQ ID NO: 468 - RNA, 19 nt, Homo sapiens
agcccaggcggcugcccgc

SEQ ID NO: 469 - RNA, 19 nt, Homo sapiens
gcccaggcggcugcccgca

SEQ ID NO: 470 - RNA, 19 nt, Homo sapiens
cccaggcggcugcccgcaa

SEQ ID NO: 471 - RNA, 19 nt, Homo sapiens
ccaggcggcugcccgcaaa

SEQ ID NO: 472 - RNA, 19 nt, Homo sapiens
caggcggcugcccgcaaac

SEQ ID NO: 473 - RNA, 19 nt, Homo sapiens
aggcggcugcccgcaaacc

SEQ ID NO: 474 - RNA, 19 nt, Homo sapiens
ggcggcugcccgcaaaccc

SEQ ID NO: 475 - RNA, 19 nt, Homo sapiens
gcggcugcccgcaaacccg

SEQ ID NO: 476 - RNA, 19 nt, Homo sapiens
cggcugcccgcaaacccgc

SEQ ID NO: 477 - RNA, 19 nt, Homo sapiens
ggcugcccgcaaacccgcg

SEQ ID NO: 478 - RNA, 19 nt, Homo sapiens
gcugcccgcaaacccgcgc

SEQ ID NO: 479 - RNA, 19 nt, Homo sapiens
cugcccgcaaacccgcgcg

SEQ ID NO: 480 - RNA, 19 nt, Homo sapiens
ugcccgcaaacccgcgcgu

SEQ ID NO: 481 - RNA, 19 nt, Homo sapiens
gcccgcaaacccgcgcgug

SEQ ID NO: 482 - RNA, 19 nt, Homo sapiens
cccgcaaacccgcgcgugc

SEQ ID NO: 483 - RNA, 19 nt, Homo sapiens
ccgcaaacccgcgcgugcg

SEQ ID NO: 484 - RNA, 19 nt, Homo sapiens
cgcaaacccgcgcgugcgc

SEQ ID NO: 485 - RNA, 19 nt, Homo sapiens
gcaaacccgcgcgugcgca

SEQ ID NO: 486 - RNA, 19 nt, Homo sapiens
caaacccgcgcgugcgcag

SEQ ID NO: 487 - RNA, 19 nt, Homo sapiens
aaacccgcgcgugcgcagu

SEQ ID NO: 488 - RNA, 19 nt, Homo sapiens
aacccgcgcgugcgcagua

SEQ ID NO: 489 - RNA, 19 nt, Homo sapiens
acccgcgcgugcgcaguag

SEQ ID NO: 490 - RNA, 19 nt, Homo sapiens
cccgcgcgugcgcaguagg

SEQ ID NO: 491 - RNA, 19 nt, Homo sapiens
ccgcgcgugcgcaguaggc

SEQ ID NO: 492 - RNA, 19 nt, Homo sapiens
cgcgcgugcgcaguaggcg

SEQ ID NO: 493 - RNA, 19 nt, Homo sapiens
gcgcgugcgcaguaggcgg

SEQ ID NO: 494 - RNA, 19 nt, Homo sapiens
cgcgugcgcaguaggcggc

SEQ ID NO: 495 - RNA, 19 nt, Homo sapiens
gcgugcgcaguaggcggcc

SEQ ID NO: 496 - RNA, 19 nt, Homo sapiens
cgugcgcaguaggcggccc

SEQ ID NO: 497 - RNA, 19 nt, Homo sapiens
gugcgcaguaggcggccca

SEQ ID NO: 498 - RNA, 19 nt, Homo sapiens
ugcgcaguaggcggcccac

SEQ ID NO: 499 - RNA, 19 nt, Homo sapiens
gcgcaguaggcggcccacc

SEQ ID NO: 500 - RNA, 19 nt, Homo sapiens
cgcaguaggcggcccaccu

SEQ ID NO: 501 - RNA, 19 nt, Homo sapiens
gcaguaggcggcccaccug

SEQ ID NO: 502 - RNA, 19 nt, Homo sapiens
caguaggcggcccaccugc

SEQ ID NO: 503 - RNA, 19 nt, Homo sapiens
aguaggcggcccaccugcu

SEQ ID NO: 504 - RNA, 19 nt, Homo sapiens
guaggcggcccaccugcug

SEQ ID NO: 505 - RNA, 19 nt, Homo sapiens
uaggcggcccaccugcugg

SEQ ID NO: 506 - RNA, 19 nt, Homo sapiens
aggcggcccaccugcuggu

SEQ ID NO: 507 - RNA, 19 nt, Homo sapiens
ggcggcccaccugcuggua

SEQ ID NO: 508 - RNA, 19 nt, Homo sapiens
gcggcccaccugcugguac

SEQ ID NO: 509 - RNA, 19 nt, Homo sapiens
cggcccaccugcugguacc

SEQ ID NO: 510 - RNA, 19 nt, Homo sapiens
ggcccaccugcugguaccu

SEQ ID NO: 511 - RNA, 19 nt, Homo sapiens
gcccaccugcugguaccug

SEQ ID NO: 512 - RNA, 19 nt, Homo sapiens
cccaccugcugguaccugg

SEQ ID NO: 513 - RNA, 19 nt, Homo sapiens
ccaccugcugguaccuggg

SEQ ID NO: 514 - RNA, 19 nt, Homo sapiens
caccugcugguaccugggc

SEQ ID NO: 515 - RNA, 19 nt, Homo sapiens
accugcugguaccugggcc

SEQ ID NO: 516 - RNA, 19 nt, Homo sapiens
ccugcugguaccugggccg

SEQ ID NO: 517 - RNA, 19 nt, Homo sapiens
cugcugguaccugggccgg

SEQ ID NO: 518 - RNA, 19 nt, Homo sapiens
ugcugguaccugggccggc

SEQ ID NO: 519 - RNA, 19 nt, Homo sapiens
gcugguaccugggccggcu

SEQ ID NO: 520 - RNA, 19 nt, Homo sapiens
cugguaccugggccggcuc

SEQ ID NO: 521 - RNA, 19 nt, Homo sapiens
ugguaccugggccggcucu

SEQ ID NO: 522 - RNA, 19 nt, Homo sapiens
gguaccugggccggcucug

SEQ ID NO: 523 - RNA, 19 nt, Homo sapiens
guaccugggccggcucugg

SEQ ID NO: 524 - RNA, 19 nt, Homo sapiens
uaccugggccggcucuggg

SEQ ID NO: 525 - RNA, 19 nt, Homo sapiens
accugggccggcucuggga

SEQ ID NO: 526 - RNA, 19 nt, Homo sapiens
ccugggccggcucugggau

SEQ ID NO: 527 - RNA, 19 nt, Homo sapiens
cugggccggcucugggauc

SEQ ID NO: 528 - RNA, 19 nt, Homo sapiens
ugggccggcucugggaucc

SEQ ID NO: 529 - RNA, 19 nt, Homo sapiens
gggccggcucugggauccc

SEQ ID NO: 530 - RNA, 19 nt, Homo sapiens
ggccggcucugggaucccc

SEQ ID NO: 531 - RNA, 19 nt, Homo sapiens
gccggcucugggauccccg

SEQ ID NO: 532 - RNA, 19 nt, Homo sapiens
ccggcucugggauccccgg

SEQ ID NO: 533 - RNA, 19 nt, Homo sapiens
cggcucugggauccccggg

SEQ ID NO: 534 - RNA, 19 nt, Homo sapiens
ggcucugggauccccggga

SEQ ID NO: 535 - RNA, 19 nt, Homo sapiens
gcucugggauccccgggau

SEQ ID NO: 536 - RNA, 19 nt, Homo sapiens
cucugggauccccgggaug

SEQ ID NO: 537 - RNA, 19 nt, Homo sapiens
ucugggauccccgggaugc

SEQ ID NO: 538 - RNA, 19 nt, Homo sapiens
cugggauccccgggaugcc

SEQ ID NO: 539 - RNA, 19 nt, Homo sapiens
ugggauccccgggaugccc

SEQ ID NO: 540 - RNA, 19 nt, Homo sapiens
gggauccccgggaugccca

SEQ ID NO: 541 - RNA, 19 nt, Homo sapiens
ggauccccgggaugcccag

SEQ ID NO: 542 - RNA, 19 nt, Homo sapiens
gauccccgggaugcccagg

SEQ ID NO: 543 - RNA, 19 nt, Homo sapiens
auccccgggaugcccagga

SEQ ID NO: 544 - RNA, 19 nt, Homo sapiens
uccccgggaugcccaggaa

SEQ ID NO: 545 - RNA, 19 nt, Homo sapiens
ccccgggaugcccaggaaa

SEQ ID NO: 546 - RNA, 19 nt, Homo sapiens
cccgggaugcccaggaaag

SEQ ID NO: 547 - RNA, 19 nt, Homo sapiens
ccgggaugcccaggaaaga

SEQ ID NO: 548 - RNA, 19 nt, Homo sapiens
cgggaugcccaggaaagaa

SEQ ID NO: 549 - RNA, 19 nt, Homo sapiens
gggaugcccaggaaagaau

SEQ ID NO: 550 - RNA, 19 nt, Homo sapiens
ggaugcccaggaaagaaug

SEQ ID NO: 551 - RNA, 19 nt, Homo sapiens
gaugcccaggaaagaaugg

SEQ ID NO: 552 - RNA, 19 nt, Homo sapiens
augcccaggaaagaauggc

SEQ ID NO: 553 - RNA, 19 nt, Homo sapiens
ugcccaggaaagaauggca

SEQ ID NO: 554 - RNA, 19 nt, Homo sapiens
gcccaggaaagaauggcag

SEQ ID NO: 555 - RNA, 19 nt, Homo sapiens
cccaggaaagaauggcagu

SEQ ID NO: 556 - RNA, 19 nt, Homo sapiens
ccaggaaagaauggcaguu

SEQ ID NO: 557 - RNA, 19 nt, Homo sapiens
caggaaagaauggcaguuc

SEQ ID NO: 558 - RNA, 19 nt, Homo sapiens
aggaaagaauggcaguucu

SEQ ID NO: 559 - RNA, 19 nt, Homo sapiens
ggaaagaauggcaguucuc

SEQ ID NO: 560 - RNA, 19 nt, Homo sapiens
gaaagaauggcaguucucc

SEQ ID NO: 561 - RNA, 19 nt, Homo sapiens
aaagaauggcaguucuccg

SEQ ID NO: 562 - RNA, 19 nt, Homo sapiens
aagaauggcaguucuccgc

SEQ ID NO: 563 - RNA, 19 nt, Homo sapiens
agaauggcaguucuccgcg

SEQ ID NO: 564 - RNA, 19 nt, Homo sapiens
gaauggcaguucuccgcgg

SEQ ID NO: 565 - RNA, 19 nt, Homo sapiens
aauggcaguucuccgcggu

SEQ ID NO: 566 - RNA, 19 nt, Homo sapiens
auggcaguucuccgcggug

SEQ ID NO: 567 - RNA, 19 nt, Homo sapiens
uggcaguucuccgcggugu

SEQ ID NO: 568 - RNA, 19 nt, Homo sapiens
ggcaguucuccgcggugug

SEQ ID NO: 569 - RNA, 19 nt, Homo sapiens
gcaguucuccgcggugugg

SEQ ID NO: 570 - RNA, 19 nt, Homo sapiens
caguucuccgcggugugga

SEQ ID NO: 571 - RNA, 19 nt, Homo sapiens
aguucuccgcgguguggag

SEQ ID NO: 572 - RNA, 19 nt, Homo sapiens
guucuccgcgguguggagu

SEQ ID NO: 573 - RNA, 19 nt, Homo sapiens
uucuccgcgguguggaguc

SEQ ID NO: 574 - RNA, 19 nt, Homo sapiens
ucuccgcgguguggagucu

SEQ ID NO: 575 - RNA, 19 nt, Homo sapiens
cuccgcgguguggagucuc

SEQ ID NO: 576 - RNA, 19 nt, Homo sapiens
uccgcgguguggagucucu

SEQ ID NO: 577 - RNA, 19 nt, Homo sapiens
ccgcgguguggagucucuc

SEQ ID NO: 578 - RNA, 19 nt, Homo sapiens
cgcgguguggagucucuca

SEQ ID NO: 579 - RNA, 19 nt, Homo sapiens
gcgguguggagucucucac

SEQ ID NO: 580 - RNA, 19 nt, Homo sapiens
cgguguggagucucucacc

SEQ ID NO: 581 - RNA, 19 nt, Homo sapiens
gguguggagucucucaccg

SEQ ID NO: 582 - RNA, 19 nt, Homo sapiens
guguggagucucucaccgg

SEQ ID NO: 583 - RNA, 19 nt, Homo sapiens
uguggagucucucaccggg

SEQ ID NO: 584 - RNA, 19 nt, Homo sapiens
guggagucucucaccgggc

SEQ ID NO: 585 - RNA, 19 nt, Homo sapiens
uggagucucucaccgggcc

SEQ ID NO: 586 - RNA, 19 nt, Homo sapiens
ggagucucucaccgggccu

SEQ ID NO: 587 - RNA, 19 nt, Homo sapiens
gagucucucaccgggccua

SEQ ID NO: 588 - RNA, 19 nt, Homo sapiens
agucucucaccgggccuag

SEQ ID NO: 589 - RNA, 19 nt, Homo sapiens
gucucucaccgggccuaga

SEQ ID NO: 590 - RNA, 19 nt, Homo sapiens
ucucucaccgggccuagac

SEQ ID NO: 591 - RNA, 19 nt, Homo sapiens
cucucaccgggccuagacc

SEQ ID NO: 592 - RNA, 19 nt, Homo sapiens
ucucaccgggccuagaccu

SEQ ID NO: 593 - RNA, 19 nt, Homo sapiens
cucaccgggccuagaccua

SEQ ID NO: 594 - RNA, 19 nt, Homo sapiens
ucaccgggccuagaccuag

SEQ ID NO: 595 - RNA, 19 nt, Homo sapiens
caccgggccuagaccuaga

SEQ ID NO: 596 - RNA, 19 nt, Homo sapiens
accgggccuagaccuagaa

SEQ ID NO: 597 - RNA, 19 nt, Homo sapiens
ccgggccuagaccuagaag

SEQ ID NO: 598 - RNA, 19 nt, Homo sapiens
cgggccuagaccuagaagg

SEQ ID NO: 599 - RNA, 19 nt, Homo sapiens
gggccuagaccuagaaggc

SEQ ID NO: 600 - RNA, 19 nt, Homo sapiens
ggccuagaccuagaaggca

SEQ ID NO: 601 - RNA, 19 nt, Homo sapiens
gccuagaccuagaaggcag

SEQ ID NO: 602 - RNA, 19 nt, Homo sapiens
ccuagaccuagaaggcagg

SEQ ID NO: 603 - RNA, 19 nt, Homo sapiens
cuagaccuagaaggcagga

SEQ ID NO: 604 - RNA, 19 nt, Homo sapiens
uagaccuagaaggcaggaa

SEQ ID NO: 605 - RNA, 19 nt, Homo sapiens
agaccuagaaggcaggaau

SEQ ID NO: 606 - RNA, 19 nt, Homo sapiens
gaccuagaaggcaggaauc

SEQ ID NO: 607 - RNA, 19 nt, Homo sapiens
accuagaaggcaggaaucc

SEQ ID NO: 608 - RNA, 19 nt, Homo sapiens
ccuagaaggcaggaauccc

SEQ ID NO: 609 - RNA, 19 nt, Homo sapiens
cuagaaggcaggaauccca

SEQ ID NO: 610 - RNA, 19 nt, Homo sapiens
uagaaggcaggaaucccag

SEQ ID NO: 611 - RNA, 19 nt, Homo sapiens
agaaggcaggaaucccagg

SEQ ID NO: 612 - RNA, 19 nt, Homo sapiens
gaaggcaggaaucccaggc

SEQ ID NO: 613 - RNA, 19 nt, Homo sapiens
aaggcaggaaucccaggcc

SEQ ID NO: 614 - RNA, 19 nt, Homo sapiens
aggcaggaaucccaggccg

SEQ ID NO: 615 - RNA, 19 nt, Homo sapiens
ggcaggaaucccaggccgg

SEQ ID NO: 616 - RNA, 19 nt, Homo sapiens
gcaggaaucccaggccggu

SEQ ID NO: 617 - RNA, 19 nt, Homo sapiens
caggaaucccaggccgguc

SEQ ID NO: 618 - RNA, 19 nt, Homo sapiens
aggaaucccaggccgguca

SEQ ID NO: 619 - RNA, 19 nt, Homo sapiens
ggaaucccaggccggucag

SEQ ID NO: 620 - RNA, 19 nt, Homo sapiens
gaaucccaggccggucagc

SEQ ID NO: 621 - RNA, 19 nt, Homo sapiens
aaucccaggccggucagcc

SEQ ID NO: 622 - RNA, 19 nt, Homo sapiens
aucccaggccggucagccc

SEQ ID NO: 623 - RNA, 19 nt, Homo sapiens
ucccaggccggucagcccg

SEQ ID NO: 624 - RNA, 19 nt, Homo sapiens
cccaggccggucagcccgg

SEQ ID NO: 625 - RNA, 19 nt, Homo sapiens
ccaggccggucagcccggu

SEQ ID NO: 626 - RNA, 19 nt, Homo sapiens
caggccggucagcccggug

SEQ ID NO: 627 - RNA, 19 nt, Homo sapiens
aggccggucagcccggugg

SEQ ID NO: 628 - RNA, 19 nt, Homo sapiens
ggccggucagcccggugga

SEQ ID NO: 629 - RNA, 19 nt, Homo sapiens
gccggucagcccgguggag

SEQ ID NO: 630 - RNA, 19 nt, Homo sapiens
ccggucagcccgguggagg

SEQ ID NO: 631 - RNA, 19 nt, Homo sapiens
cggucagcccgguggaggg

SEQ ID NO: 632 - RNA, 19 nt, Homo sapiens
ggucagcccgguggagggg

SEQ ID NO: 633 - RNA, 19 nt, Homo sapiens
gucagcccgguggaggggg

SEQ ID NO: 634 - RNA, 19 nt, Homo sapiens
ucagcccgguggagggggc

SEQ ID NO: 635 - RNA, 19 nt, Homo sapiens
cagcccgguggagggggcg

SEQ ID NO: 636 - RNA, 19 nt, Homo sapiens
agcccgguggagggggcgg

SEQ ID NO: 637 - RNA, 19 nt, Homo sapiens
gcccgguggagggggcggg

SEQ ID NO: 638 - RNA, 19 nt, Homo sapiens
cccgguggagggggcgggg

SEQ ID NO: 639 - RNA, 19 nt, Homo sapiens
ccgguggagggggcggggc

SEQ ID NO: 640 - RNA, 19 nt, Homo sapiens
cgguggagggggcggggcg

SEQ ID NO: 641 - RNA, 19 nt, Homo sapiens
gguggagggggcggggcgg

SEQ ID NO: 642 - RNA, 19 nt, Homo sapiens
guggagggggcggggcgga

SEQ ID NO: 643 - RNA, 19 nt, Homo sapiens
uggagggggcggggcggag

SEQ ID NO: 644 - RNA, 19 nt, Homo sapiens
ggagggggcggggcggaga

SEQ ID NO: 645 - RNA, 19 nt, Homo sapiens
gagggggcggggcggagac

SEQ ID NO: 646 - RNA, 19 nt, Homo sapiens
agggggcggggcggagaca

SEQ ID NO: 647 - RNA, 19 nt, Homo sapiens
gggggcggggcggagacac

SEQ ID NO: 648 - RNA, 19 nt, Homo sapiens
ggggcggggcggagacacg

SEQ ID NO: 649 - RNA, 19 nt, Homo sapiens
gggcggggcggagacacgc

SEQ ID NO: 650 - RNA, 19 nt, Homo sapiens
ggcggggcggagacacgcc

SEQ ID NO: 651 - RNA, 19 nt, Homo sapiens
gcggggcggagacacgccc

SEQ ID NO: 652 - RNA, 19 nt, Homo sapiens
cggggcggagacacgcccc

SEQ ID NO: 653 - RNA, 19 nt, Homo sapiens
ggggcggagacacgccccu

SEQ ID NO: 654 - RNA, 19 nt, Homo sapiens
gggcggagacacgccccuc

SEQ ID NO: 655 - RNA, 19 nt, Homo sapiens
ggcggagacacgccccucc

SEQ ID NO: 656 - RNA, 19 nt, Homo sapiens
gcggagacacgccccuccg

SEQ ID NO: 657 - RNA, 19 nt, Homo sapiens
cggagacacgccccuccgu

SEQ ID NO: 658 - RNA, 19 nt, Homo sapiens
ggagacacgccccuccgua

SEQ ID NO: 659 - RNA, 19 nt, Homo sapiens
gagacacgccccuccguag

SEQ ID NO: 660 - RNA, 19 nt, Homo sapiens
agacacgccccuccguagc

SEQ ID NO: 661 - RNA, 19 nt, Homo sapiens
gacacgccccuccguagcc

SEQ ID NO: 662 - RNA, 19 nt, Homo sapiens
acacgccccuccguagcca

SEQ ID NO: 663 - RNA, 19 nt, Homo sapiens
cacgccccuccguagccag

SEQ ID NO: 664 - RNA, 19 nt, Homo sapiens
acgccccuccguagccagc

SEQ ID NO: 665 - RNA, 19 nt, Homo sapiens
cgccccuccguagccagcc

SEQ ID NO: 666 - RNA, 19 nt, Homo sapiens
gccccuccguagccagcca

SEQ ID NO: 667 - RNA, 19 nt, Homo sapiens
ccccuccguagccagccag

SEQ ID NO: 668 - RNA, 19 nt, Homo sapiens
cccuccguagccagccagg

SEQ ID NO: 669 - RNA, 19 nt, Homo sapiens
ccuccguagccagccaggu

SEQ ID NO: 670 - RNA, 19 nt, Homo sapiens
cuccguagccagccaggug

SEQ ID NO: 671 - RNA, 19 nt, Homo sapiens
uccguagccagccaggugu

SEQ ID NO: 672 - RNA, 19 nt, Homo sapiens
ccguagccagccagguguu

SEQ ID NO: 673 - RNA, 19 nt, Homo sapiens
cguagccagccagguguuc

SEQ ID NO: 674 - RNA, 19 nt, Homo sapiens
guagccagccagguguucc

SEQ ID NO: 675 - RNA, 19 nt, Homo sapiens
uagccagccagguguuccc

SEQ ID NO: 676 - RNA, 19 nt, Homo sapiens
agccagccagguguucccc

SEQ ID NO: 677 - RNA, 19 nt, Homo sapiens
gccagccagguguuccccg

SEQ ID NO: 678 - RNA, 19 nt, Homo sapiens
ccagccagguguuccccgc

SEQ ID NO: 679 - RNA, 19 nt, Homo sapiens
cagccagguguuccccgcg

SEQ ID NO: 680 - RNA, 19 nt, Homo sapiens
agccagguguuccccgcga

SEQ ID NO: 681 - RNA, 19 nt, Homo sapiens
gccagguguuccccgcgaa

SEQ ID NO: 682 - RNA, 19 nt, Homo sapiens
ccagguguuccccgcgaaa

SEQ ID NO: 683 - RNA, 19 nt, Homo sapiens
cagguguuccccgcgaaag

SEQ ID NO: 684 - RNA, 19 nt, Homo sapiens
agguguuccccgcgaaaga

SEQ ID NO: 685 - RNA, 19 nt, Homo sapiens
gguguuccccgcgaaagag

SEQ ID NO: 686 - RNA, 19 nt, Homo sapiens
guguuccccgcgaaagaga

SEQ ID NO: 687 - RNA, 19 nt, Homo sapiens
uguuccccgcgaaagagag

SEQ ID NO: 688 - RNA, 19 nt, Homo sapiens
guuccccgcgaaagagagg

SEQ ID NO: 689 - RNA, 19 nt, Homo sapiens
uuccccgcgaaagagaggc

SEQ ID NO: 690 - RNA, 19 nt, Homo sapiens
uccccgcgaaagagaggcc

SEQ ID NO: 691 - RNA, 19 nt, Homo sapiens
ccccgcgaaagagaggcca

SEQ ID NO: 692 - RNA, 19 nt, Homo sapiens
cccgcgaaagagaggccac

SEQ ID NO: 693 - RNA, 19 nt, Homo sapiens
ccgcgaaagagaggccacg

SEQ ID NO: 694 - RNA, 19 nt, Homo sapiens
cgcgaaagagaggccacgg

SEQ ID NO: 695 - RNA, 19 nt, Homo sapiens
gcgaaagagaggccacggc

SEQ ID NO: 696 - RNA, 19 nt, Homo sapiens
cgaaagagaggccacggcc

SEQ ID NO: 697 - RNA, 19 nt, Homo sapiens
gaaagagaggccacggccc

SEQ ID NO: 698 - RNA, 19 nt, Homo sapiens
aaagagaggccacggcccu

SEQ ID NO: 699 - RNA, 19 nt, Homo sapiens
aagagaggccacggcccug

SEQ ID NO: 700 - RNA, 19 nt, Homo sapiens
agagaggccacggcccugc

SEQ ID NO: 701 - RNA, 19 nt, Homo sapiens
gagaggccacggcccugcc

SEQ ID NO: 702 - RNA, 19 nt, Homo sapiens
agaggccacggcccugccc

SEQ ID NO: 703 - RNA, 19 nt, Homo sapiens
gaggccacggcccugcccc

SEQ ID NO: 704 - RNA, 19 nt, Homo sapiens
aggccacggcccugccccg

SEQ ID NO: 705 - RNA, 19 nt, Homo sapiens
ggccacggcccugccccga

SEQ ID NO: 706 - RNA, 19 nt, Homo sapiens
gccacggcccugccccgaa

SEQ ID NO: 707 - RNA, 19 nt, Homo sapiens
ccacggcccugccccgaac

SEQ ID NO: 708 - RNA, 19 nt, Homo sapiens
cacggcccugccccgaacc

SEQ ID NO: 709 - RNA, 19 nt, Homo sapiens
acggcccugccccgaacca

SEQ ID NO: 710 - RNA, 19 nt, Homo sapiens
cggcccugccccgaaccac

SEQ ID NO: 711 - RNA, 19 nt, Homo sapiens
ggcccugccccgaaccacc

SEQ ID NO: 712 - RNA, 19 nt, Homo sapiens
gcccugccccgaaccaccc

SEQ ID NO: 713 - RNA, 19 nt, Homo sapiens
cccugccccgaaccacccg

SEQ ID NO: 714 - RNA, 19 nt, Homo sapiens
ccugccccgaaccacccga

SEQ ID NO: 715 - RNA, 19 nt, Homo sapiens
cugccccgaaccacccgac

SEQ ID NO: 716 - RNA, 19 nt, Homo sapiens
ugccccgaaccacccgacc

SEQ ID NO: 717 - RNA, 19 nt, Homo sapiens
gccccgaaccacccgaccc

SEQ ID NO: 718 - RNA, 19 nt, Homo sapiens
ccccgaaccacccgacccc

SEQ ID NO: 719 - RNA, 19 nt, Homo sapiens
cccgaaccacccgaccccg

SEQ ID NO: 720 - RNA, 19 nt, Homo sapiens
ccgaaccacccgaccccgu

SEQ ID NO: 721 - RNA, 19 nt, Homo sapiens
cgaaccacccgaccccguc

SEQ ID NO: 722 - RNA, 19 nt, Homo sapiens
gaaccacccgaccccgucc

SEQ ID NO: 723 - RNA, 19 nt, Homo sapiens
aaccacccgaccccguccc

SEQ ID NO: 724 - RNA, 19 nt, Homo sapiens
accacccgaccccguccca

SEQ ID NO: 725 - RNA, 19 nt, Homo sapiens
ccacccgaccccgucccaa

SEQ ID NO: 726 - RNA, 19 nt, Homo sapiens
cacccgaccccgucccaac

SEQ ID NO: 727 - RNA, 19 nt, Homo sapiens
acccgaccccgucccaacc

SEQ ID NO: 728 - RNA, 19 nt, Homo sapiens
cccgaccccgucccaaccc

SEQ ID NO: 729 - RNA, 19 nt, Homo sapiens
ccgaccccgucccaacccc

SEQ ID NO: 730 - RNA, 19 nt, Homo sapiens
cgaccccgucccaaccccg

SEQ ID NO: 731 - RNA, 19 nt, Homo sapiens
gaccccgucccaaccccgc

SEQ ID NO: 732 - RNA, 19 nt, Homo sapiens
accccgucccaaccccgcg

SEQ ID NO: 733 - RNA, 19 nt, Homo sapiens
ccccgucccaaccccgcgu

SEQ ID NO: 734 - RNA, 19 nt, Homo sapiens
cccgucccaaccccgcguc

SEQ ID NO: 735 - RNA, 19 nt, Homo sapiens
ccgucccaaccccgcgucc

SEQ ID NO: 736 - RNA, 19 nt, Homo sapiens
cgucccaaccccgcguccu

SEQ ID NO: 737 - RNA, 19 nt, Homo sapiens
gucccaaccccgcguccua

SEQ ID NO: 738 - RNA, 19 nt, Homo sapiens
ucccaaccccgcguccuaa

SEQ ID NO: 739 - RNA, 19 nt, Homo sapiens
cccaaccccgcguccuaaa

SEQ ID NO: 740 - RNA, 19 nt, Homo sapiens
ccaaccccgcguccuaaag

SEQ ID NO: 741 - RNA, 19 nt, Homo sapiens
caaccccgcguccuaaagc

SEQ ID NO: 742 - RNA, 19 nt, Homo sapiens
aaccccgcguccuaaagcu

SEQ ID NO: 743 - RNA, 19 nt, Homo sapiens
accccgcguccuaaagcuc

SEQ ID NO: 744 - RNA, 19 nt, Homo sapiens
ccccgcguccuaaagcucc

SEQ ID NO: 745 - RNA, 19 nt, Homo sapiens
cccgcguccuaaagcuccu

SEQ ID NO: 746 - RNA, 19 nt, Homo sapiens
ccgcguccuaaagcuccuc

SEQ ID NO: 747 - RNA, 19 nt, Homo sapiens
cgcguccuaaagcuccucc

SEQ ID NO: 748 - RNA, 19 nt, Homo sapiens
gcguccuaaagcuccucca

SEQ ID NO: 749 - RNA, 19 nt, Homo sapiens
cguccuaaagcuccuccag

SEQ ID NO: 750 - RNA, 19 nt, Homo sapiens
guccuaaagcuccuccagc

SEQ ID NO: 751 - RNA, 19 nt, Homo sapiens
uccuaaagcuccuccagca

SEQ ID NO: 752 - RNA, 19 nt, Homo sapiens
ccuaaagcuccuccagcag

SEQ ID NO: 753 - RNA, 19 nt, Homo sapiens
cuaaagcuccuccagcaga

SEQ ID NO: 754 - RNA, 19 nt, Homo sapiens
uaaagcuccuccagcagag

SEQ ID NO: 755 - RNA, 19 nt, Homo sapiens
aaagcuccuccagcagagc

SEQ ID NO: 756 - RNA, 19 nt, Homo sapiens
aagcuccuccagcagagcc

SEQ ID NO: 757 - RNA, 19 nt, Homo sapiens
agcuccuccagcagagccc

SEQ ID NO: 758 - RNA, 19 nt, Homo sapiens
gcuccuccagcagagcccg

SEQ ID NO: 759 - RNA, 19 nt, Homo sapiens
cuccuccagcagagcccgg

SEQ ID NO: 760 - RNA, 19 nt, Homo sapiens
uccuccagcagagcccggu

SEQ ID NO: 761 - RNA, 19 nt, Homo sapiens
ccuccagcagagcccggua

SEQ ID NO: 762 - RNA, 19 nt, Homo sapiens
cuccagcagagcccgguau

SEQ ID NO: 763 - RNA, 19 nt, Homo sapiens
uccagcagagcccgguauu

SEQ ID NO: 764 - RNA, 19 nt, Homo sapiens
ccagcagagcccgguauuc

SEQ ID NO: 765 - RNA, 19 nt, Homo sapiens
cagcagagcccgguauucu

SEQ ID NO: 766 - RNA, 19 nt, Homo sapiens
agcagagcccgguauucuu

SEQ ID NO: 767 - RNA, 19 nt, Homo sapiens
gcagagcccgguauucuuc

SEQ ID NO: 768 - RNA, 19 nt, Homo sapiens
cagagcccgguauucuucc

SEQ ID NO: 769 - RNA, 19 nt, Homo sapiens
agagcccgguauucuuccu

SEQ ID NO: 770 - RNA, 19 nt, Homo sapiens
gagcccgguauucuuccuc

SEQ ID NO: 771 - RNA, 19 nt, Homo sapiens
agcccgguauucuuccucg

SEQ ID NO: 772 - RNA, 19 nt, Homo sapiens
gcccgguauucuuccucgc

SEQ ID NO: 773 - RNA, 19 nt, Homo sapiens
cccgguauucuuccucgcu

SEQ ID NO: 774 - RNA, 19 nt, Homo sapiens
ccgguauucuuccucgcug

SEQ ID NO: 775 - RNA, 19 nt, Homo sapiens
cgguauucuuccucgcuga

SEQ ID NO: 776 - RNA, 19 nt, Homo sapiens
gguauucuuccucgcugag

SEQ ID NO: 777 - RNA, 19 nt, Homo sapiens
guauucuuccucgcugagg

SEQ ID NO: 778 - RNA, 19 nt, Homo sapiens
uauucuuccucgcugaggg

SEQ ID NO: 779 - RNA, 19 nt, Homo sapiens
auucuuccucgcugagggg

SEQ ID NO: 780 - RNA, 19 nt, Homo sapiens
uucuuccucgcugaggggu

SEQ ID NO: 781 - RNA, 19 nt, Homo sapiens
ucuuccucgcugaggggug

SEQ ID NO: 782 - RNA, 19 nt, Homo sapiens
cuuccucgcugaggggugc

SEQ ID NO: 783 - RNA, 19 nt, Homo sapiens
uuccucgcugaggggugcu

SEQ ID NO: 784 - RNA, 19 nt, Homo sapiens
uccucgcugaggggugcuu

SEQ ID NO: 785 - RNA, 19 nt, Homo sapiens
ccucgcugaggggugcuuc

SEQ ID NO: 786 - RNA, 19 nt, Homo sapiens
cucgcugaggggugcuucc

SEQ ID NO: 787 - RNA, 19 nt, Homo sapiens
ucgcugaggggugcuucca

SEQ ID NO: 788 - RNA, 19 nt, Homo sapiens
cgcugaggggugcuuccag

SEQ ID NO: 789 - RNA, 19 nt, Homo sapiens
gcugaggggugcuuccagc

SEQ ID NO: 790 - RNA, 19 nt, Homo sapiens
cugaggggugcuuccagcg

SEQ ID NO: 791 - RNA, 19 nt, Homo sapiens
ugaggggugcuuccagcga

SEQ ID NO: 792 - RNA, 19 nt, Homo sapiens
gaggggugcuuccagcgag

SEQ ID NO: 793 - RNA, 19 nt, Homo sapiens
aggggugcuuccagcgagg

SEQ ID NO: 794 - RNA, 19 nt, Homo sapiens
ggggugcuuccagcgaggc

SEQ ID NO: 795 - RNA, 19 nt, Homo sapiens
gggugcuuccagcgaggcg

SEQ ID NO: 796 - RNA, 19 nt, Homo sapiens
ggugcuuccagcgaggcgg

SEQ ID NO: 797 - RNA, 19 nt, Homo sapiens
gugcuuccagcgaggcggc

SEQ ID NO: 798 - RNA, 19 nt, Homo sapiens
ugcuuccagcgaggcggcc

SEQ ID NO: 799 - RNA, 19 nt, Homo sapiens
gcuuccagcgaggcggccu

SEQ ID NO: 800 - RNA, 19 nt, Homo sapiens
cuuccagcgaggcggccuc

SEQ ID NO: 801 - RNA, 19 nt, Homo sapiens
uuccagcgaggcggccucu

SEQ ID NO: 802 - RNA, 19 nt, Homo sapiens
uccagcgaggcggccucuu

SEQ ID NO: 803 - RNA, 19 nt, Homo sapiens
ccagcgaggcggccucuuc

SEQ ID NO: 804 - RNA, 19 nt, Homo sapiens
cagcgaggcggccucuucc

SEQ ID NO: 805 - RNA, 19 nt, Homo sapiens
agcgaggcggccucuuccg

SEQ ID NO: 806 - RNA, 19 nt, Homo sapiens
gcgaggcggccucuuccga

SEQ ID NO: 807 - RNA, 19 nt, Homo sapiens
cgaggcggccucuuccgag

SEQ ID NO: 808 - RNA, 19 nt, Homo sapiens
gaggcggccucuuccgagg

SEQ ID NO: 809 - RNA, 19 nt, Homo sapiens
aggcggccucuuccgaggc

SEQ ID NO: 810 - RNA, 19 nt, Homo sapiens
ggcggccucuuccgaggcc

SEQ ID NO: 811 - RNA, 19 nt, Homo sapiens
gcggccucuuccgaggccu

SEQ ID NO: 812 - RNA, 19 nt, Homo sapiens
cggccucuuccgaggccuc

SEQ ID NO: 813 - RNA, 19 nt, Homo sapiens
ggccucuuccgaggccucc

SEQ ID NO: 814 - RNA, 19 nt, Homo sapiens
gccucuuccgaggccucca

SEQ ID NO: 815 - RNA, 19 nt, Homo sapiens
ccucuuccgaggccuccag

SEQ ID NO: 816 - RNA, 19 nt, Homo sapiens
cucuuccgaggccuccagc

SEQ ID NO: 817 - RNA, 19 nt, Homo sapiens
ucuuccgaggccuccagcu

SEQ ID NO: 818 - RNA, 19 nt, Homo sapiens
cuuccgaggccuccagcuc

SEQ ID NO: 819 - RNA, 19 nt, Homo sapiens
uuccgaggccuccagcucc

SEQ ID NO: 820 - RNA, 19 nt, Homo sapiens
uccgaggccuccagcuccc

SEQ ID NO: 821 - RNA, 19 nt, Homo sapiens
ccgaggccuccagcucccc

SEQ ID NO: 822 - RNA, 19 nt, Homo sapiens
cgaggccuccagcuccccc

SEQ ID NO: 823 - RNA, 19 nt, Homo sapiens
gaggccuccagcucccccg

SEQ ID NO: 824 - RNA, 19 nt, Homo sapiens
aggccuccagcucccccgg

SEQ ID NO: 825 - RNA, 19 nt, Homo sapiens
ggccuccagcucccccggg

SEQ ID NO: 826 - RNA, 19 nt, Homo sapiens
gccuccagcucccccgggg

SEQ ID NO: 827 - RNA, 19 nt, Homo sapiens
ccuccagcucccccggggc

SEQ ID NO: 828 - RNA, 19 nt, Homo sapiens
cuccagcucccccggggcc

SEQ ID NO: 829 - RNA, 19 nt, Homo sapiens
uccagcucccccggggccu

SEQ ID NO: 830 - RNA, 19 nt, Homo sapiens
ccagcucccccggggccuc

SEQ ID NO: 831 - RNA, 19 nt, Homo sapiens
cagcucccccggggccucc

SEQ ID NO: 832 - RNA, 19 nt, Homo sapiens
agcucccccggggccuccg

SEQ ID NO: 833 - RNA, 19 nt, Homo sapiens
gcucccccggggccuccgu

SEQ ID NO: 834 - RNA, 19 nt, Homo sapiens
cucccccggggccuccguu

SEQ ID NO: 835 - RNA, 19 nt, Homo sapiens
ucccccggggccuccguuu

SEQ ID NO: 836 - RNA, 19 nt, Homo sapiens
cccccggggccuccguuuc

SEQ ID NO: 837 - RNA, 19 nt, Homo sapiens
ccccggggccuccguuucu

SEQ ID NO: 838 - RNA, 19 nt, Homo sapiens
cccggggccuccguuucua

SEQ ID NO: 839 - RNA, 19 nt, Homo sapiens
ccggggccuccguuucuag

SEQ ID NO: 840 - RNA, 19 nt, Homo sapiens
cggggccuccguuucuagg

SEQ ID NO: 841 - RNA, 19 nt, Homo sapiens
ggggccuccguuucuagga

SEQ ID NO: 842 - RNA, 19 nt, Homo sapiens
gggccuccguuucuaggag

SEQ ID NO: 843 - RNA, 19 nt, Homo sapiens
ggccuccguuucuaggaga

SEQ ID NO: 844 - RNA, 19 nt, Homo sapiens
gccuccguuucuaggagag

SEQ ID NO: 845 - RNA, 19 nt, Homo sapiens
ccuccguuucuaggagagg

SEQ ID NO: 846 - RNA, 19 nt, Homo sapiens
cuccguuucuaggagaggu

SEQ ID NO: 847 - RNA, 19 nt, Homo sapiens
uccguuucuaggagagguu

SEQ ID NO: 848 - RNA, 19 nt, Homo sapiens
ccguuucuaggagagguug

SEQ ID NO: 849 - RNA, 19 nt, Homo sapiens
cguuucuaggagagguugc

SEQ ID NO: 850 - RNA, 19 nt, Homo sapiens
guuucuaggagagguugcg

SEQ ID NO: 851 - RNA, 19 nt, Homo sapiens
uuucuaggagagguugcgc

SEQ ID NO: 852 - RNA, 19 nt, Homo sapiens
uucuaggagagguugcgcc

SEQ ID NO: 853 - RNA, 19 nt, Homo sapiens
ucuaggagagguugcgccu

SEQ ID NO: 854 - RNA, 19 nt, Homo sapiens
cuaggagagguugcgccug

SEQ ID NO: 855 - RNA, 19 nt, Homo sapiens
uaggagagguugcgccugc

SEQ ID NO: 856 - RNA, 19 nt, Homo sapiens
aggagagguugcgccugcu

SEQ ID NO: 857 - RNA, 19 nt, Homo sapiens
ggagagguugcgccugcug

SEQ ID NO: 858 - RNA, 19 nt, Homo sapiens
gagagguugcgccugcugc

SEQ ID NO: 859 - RNA, 19 nt, Homo sapiens
agagguugcgccugcugca

SEQ ID NO: 860 - RNA, 19 nt, Homo sapiens
gagguugcgccugcugcag

SEQ ID NO: 861 - RNA, 19 nt, Homo sapiens
agguugcgccugcugcaga

SEQ ID NO: 862 - RNA, 19 nt, Homo sapiens
gguugcgccugcugcagaa

SEQ ID NO: 863 - RNA, 19 nt, Homo sapiens
guugcgccugcugcagaaa

SEQ ID NO: 864 - RNA, 19 nt, Homo sapiens
uugcgccugcugcagaaac

SEQ ID NO: 865 - RNA, 19 nt, Homo sapiens
ugcgccugcugcagaaacu

SEQ ID NO: 866 - RNA, 19 nt, Homo sapiens
gcgccugcugcagaaacuc

SEQ ID NO: 867 - RNA, 19 nt, Homo sapiens
cgccugcugcagaaacucc

SEQ ID NO: 868 - RNA, 19 nt, Homo sapiens
gccugcugcagaaacuccg

SEQ ID NO: 869 - RNA, 19 nt, Homo sapiens
ccugcugcagaaacuccgg

SEQ ID NO: 870 - RNA, 19 nt, Homo sapiens
cugcugcagaaacuccggg

SEQ ID NO: 871 - RNA, 19 nt, Homo sapiens
ugcugcagaaacuccgggc

SEQ ID NO: 872 - RNA, 19 nt, Homo sapiens
gcugcagaaacuccgggcu

SEQ ID NO: 873 - RNA, 19 nt, Homo sapiens
cugcagaaacuccgggcuc

SEQ ID NO: 874 - RNA, 19 nt, Homo sapiens
ugcagaaacuccgggcucg

SEQ ID NO: 875 - RNA, 19 nt, Homo sapiens
gcagaaacuccgggcucgc

SEQ ID NO: 876 - RNA, 19 nt, Homo sapiens
cagaaacuccgggcucgcc

SEQ ID NO: 877 - RNA, 19 nt, Homo sapiens
agaaacuccgggcucgcca

SEQ ID NO: 878 - RNA, 19 nt, Homo sapiens
gaaacuccgggcucgccag

SEQ ID NO: 879 - RNA, 19 nt, Homo sapiens
aaacuccgggcucgccagg

SEQ ID NO: 880 - RNA, 19 nt, Homo sapiens
aacuccgggcucgccagga

SEQ ID NO: 881 - RNA, 19 nt, Homo sapiens
acuccgggcucgccaggag

SEQ ID NO: 882 - RNA, 19 nt, Homo sapiens
cuccgggcucgccaggagc

SEQ ID NO: 883 - RNA, 19 nt, Homo sapiens
uccgggcucgccaggagcu

SEQ ID NO: 884 - RNA, 19 nt, Homo sapiens
ccgggcucgccaggagcuc

SEQ ID NO: 885 - RNA, 19 nt, Homo sapiens
cgggcucgccaggagcuca

SEQ ID NO: 886 - RNA, 19 nt, Homo sapiens
gggcucgccaggagcucau

SEQ ID NO: 887 - RNA, 19 nt, Homo sapiens
ggcucgccaggagcucauc

SEQ ID NO: 888 - RNA, 19 nt, Homo sapiens
gcucgccaggagcucaucc

SEQ ID NO: 889 - RNA, 19 nt, Homo sapiens
cucgccaggagcucaucca

SEQ ID NO: 890 - RNA, 19 nt, Homo sapiens
ucgccaggagcucauccag

SEQ ID NO: 891 - RNA, 19 nt, Homo sapiens
cgccaggagcucauccagc

SEQ ID NO: 892 - RNA, 19 nt, Homo sapiens
gccaggagcucauccagca

SEQ ID NO: 893 - RNA, 19 nt, Homo sapiens
ccaggagcucauccagcag

SEQ ID NO: 894 - RNA, 19 nt, Homo sapiens
caggagcucauccagcagc

SEQ ID NO: 895 - RNA, 19 nt, Homo sapiens
aggagcucauccagcagca

SEQ ID NO: 896 - RNA, 19 nt, Homo sapiens
ggagcucauccagcagcag

SEQ ID NO: 897 - RNA, 19 nt, Homo sapiens
gagcucauccagcagcagg

SEQ ID NO: 898 - RNA, 19 nt, Homo sapiens
agcucauccagcagcaggc

SEQ ID NO: 899 - RNA, 19 nt, Homo sapiens
gcucauccagcagcaggcc

SEQ ID NO: 900 - RNA, 19 nt, Homo sapiens
cucauccagcagcaggccg

SEQ ID NO: 901 - RNA, 19 nt, Homo sapiens
ucauccagcagcaggccgc

SEQ ID NO: 902 - RNA, 19 nt, Homo sapiens
cauccagcagcaggccgca

SEQ ID NO: 903 - RNA, 19 nt, Homo sapiens
auccagcagcaggccgcag

SEQ ID NO: 904 - RNA, 19 nt, Homo sapiens
uccagcagcaggccgcagg

SEQ ID NO: 905 - RNA, 19 nt, Homo sapiens
ccagcagcaggccgcaggg

SEQ ID NO: 906 - RNA, 19 nt, Homo sapiens
cagcagcaggccgcagggg

SEQ ID NO: 907 - RNA, 19 nt, Homo sapiens
agcagcaggccgcagggga

SEQ ID NO: 908 - RNA, 19 nt, Homo sapiens
gcagcaggccgcaggggag

SEQ ID NO: 909 - RNA, 19 nt, Homo sapiens
cagcaggccgcaggggagu

SEQ ID NO: 910 - RNA, 19 nt, Homo sapiens
agcaggccgcaggggagug

SEQ ID NO: 911 - RNA, 19 nt, Homo sapiens
gcaggccgcaggggagugc

SEQ ID NO: 912 - RNA, 19 nt, Homo sapiens
caggccgcaggggagugca

SEQ ID NO: 913 - RNA, 19 nt, Homo sapiens
aggccgcaggggagugcag

SEQ ID NO: 914 - RNA, 19 nt, Homo sapiens
ggccgcaggggagugcaga

SEQ ID NO: 915 - RNA, 19 nt, Homo sapiens
gccgcaggggagugcagac

SEQ ID NO: 916 - RNA, 19 nt, Homo sapiens
ccgcaggggagugcagacc

SEQ ID NO: 917 - RNA, 19 nt, Homo sapiens
cgcaggggagugcagacca

SEQ ID NO: 918 - RNA, 19 nt, Homo sapiens
gcaggggagugcagaccag

SEQ ID NO: 919 - RNA, 19 nt, Homo sapiens
caggggagugcagaccagg

SEQ ID NO: 920 - RNA, 19 nt, Homo sapiens
aggggagugcagaccaggg

SEQ ID NO: 921 - RNA, 19 nt, Homo sapiens
ggggagugcagaccagggc

SEQ ID NO: 922 - RNA, 19 nt, Homo sapiens
gggagugcagaccagggcg

SEQ ID NO: 923 - RNA, 19 nt, Homo sapiens
ggagugcagaccagggcgc

SEQ ID NO: 924 - RNA, 19 nt, Homo sapiens
gagugcagaccagggcgcc

SEQ ID NO: 925 - RNA, 19 nt, Homo sapiens
agugcagaccagggcgccg

SEQ ID NO: 926 - RNA, 19 nt, Homo sapiens
gugcagaccagggcgccgg

SEQ ID NO: 927 - RNA, 19 nt, Homo sapiens
ugcagaccagggcgccggc

SEQ ID NO: 928 - RNA, 19 nt, Homo sapiens
gcagaccagggcgccggcu

SEQ ID NO: 929 - RNA, 19 nt, Homo sapiens
cagaccagggcgccggcuc

SEQ ID NO: 930 - RNA, 19 nt, Homo sapiens
agaccagggcgccggcucc

SEQ ID NO: 931 - RNA, 19 nt, Homo sapiens
gaccagggcgccggcuccu

SEQ ID NO: 932 - RNA, 19 nt, Homo sapiens
accagggcgccggcuccug

SEQ ID NO: 933 - RNA, 19 nt, Homo sapiens
ccagggcgccggcuccugg

SEQ ID NO: 934 - RNA, 19 nt, Homo sapiens
cagggcgccggcuccugga

SEQ ID NO: 935 - RNA, 19 nt, Homo sapiens
agggcgccggcuccuggag

SEQ ID NO: 936 - RNA, 19 nt, Homo sapiens
gggcgccggcuccuggagc

SEQ ID NO: 937 - RNA, 19 nt, Homo sapiens
ggcgccggcuccuggagcg

SEQ ID NO: 938 - RNA, 19 nt, Homo sapiens
gcgccggcuccuggagcgc

SEQ ID NO: 939 - RNA, 19 nt, Homo sapiens
cgccggcuccuggagcgcc

SEQ ID NO: 940 - RNA, 19 nt, Homo sapiens
gccggcuccuggagcgccu

SEQ ID NO: 941 - RNA, 19 nt, Homo sapiens
ccggcuccuggagcgccug

SEQ ID NO: 942 - RNA, 19 nt, Homo sapiens
cggcuccuggagcgccugg

SEQ ID NO: 943 - RNA, 19 nt, Homo sapiens
ggcuccuggagcgccuggg

SEQ ID NO: 944 - RNA, 19 nt, Homo sapiens
gcuccuggagcgccuggga

SEQ ID NO: 945 - RNA, 19 nt, Homo sapiens
cuccuggagcgccugggag

SEQ ID NO: 946 - RNA, 19 nt, Homo sapiens
uccuggagcgccugggagg

SEQ ID NO: 947 - RNA, 19 nt, Homo sapiens
ccuggagcgccugggaggg

SEQ ID NO: 948 - RNA, 19 nt, Homo sapiens
cuggagcgccugggagggc

SEQ ID NO: 949 - RNA, 19 nt, Homo sapiens
uggagcgccugggagggcg

SEQ ID NO: 950 - RNA, 19 nt, Homo sapiens
ggagcgccugggagggcgc

SEQ ID NO: 951 - RNA, 19 nt, Homo sapiens
gagcgccugggagggcgcc

SEQ ID NO: 952 - RNA, 19 nt, Homo sapiens
agcgccugggagggcgccg

SEQ ID NO: 953 - RNA, 19 nt, Homo sapiens
gcgccugggagggcgccgg

SEQ ID NO: 954 - RNA, 19 nt, Homo sapiens
cgccugggagggcgccggg

SEQ ID NO: 955 - RNA, 19 nt, Homo sapiens
gccugggagggcgccggga

SEQ ID NO: 956 - RNA, 19 nt, Homo sapiens
ccugggagggcgccgggau

SEQ ID NO: 957 - RNA, 19 nt, Homo sapiens
cugggagggcgccgggaug

SEQ ID NO: 958 - RNA, 19 nt, Homo sapiens
ugggagggcgccgggaugc

SEQ ID NO: 959 - RNA, 19 nt, Homo sapiens
gggagggcgccgggaugcc

SEQ ID NO: 960 - RNA, 19 nt, Homo sapiens
ggagggcgccgggaugccu

SEQ ID NO: 961 - RNA, 19 nt, Homo sapiens
gagggcgccgggaugccuu

SEQ ID NO: 962 - RNA, 19 nt, Homo sapiens
agggcgccgggaugccuug

SEQ ID NO: 963 - RNA, 19 nt, Homo sapiens
gggcgccgggaugccuugc

SEQ ID NO: 964 - RNA, 19 nt, Homo sapiens
ggcgccgggaugccuugca

SEQ ID NO: 965 - RNA, 19 nt, Homo sapiens
gcgccgggaugccuugcau

SEQ ID NO: 966 - RNA, 19 nt, Homo sapiens
cgccgggaugccuugcauc

SEQ ID NO: 967 - RNA, 19 nt, Homo sapiens
gccgggaugccuugcaucu

SEQ ID NO: 968 - RNA, 19 nt, Homo sapiens
ccgggaugccuugcaucug

SEQ ID NO: 969 - RNA, 19 nt, Homo sapiens
cgggaugccuugcaucugc

SEQ ID NO: 970 - RNA, 19 nt, Homo sapiens
gggaugccuugcaucugcc

SEQ ID NO: 971 - RNA, 19 nt, Homo sapiens
ggaugccuugcaucugccc

SEQ ID NO: 972 - RNA, 19 nt, Homo sapiens
gaugccuugcaucugcccc

SEQ ID NO: 973 - RNA, 19 nt, Homo sapiens
augccuugcaucugccccu

SEQ ID NO: 974 - RNA, 19 nt, Homo sapiens
ugccuugcaucugccccug

SEQ ID NO: 975 - RNA, 19 nt, Homo sapiens
gccuugcaucugccccugc

SEQ ID NO: 976 - RNA, 19 nt, Homo sapiens
ccuugcaucugccccugcc

SEQ ID NO: 977 - RNA, 19 nt, Homo sapiens
cuugcaucugccccugccg

SEQ ID NO: 978 - RNA, 19 nt, Homo sapiens
uugcaucugccccugccgc

SEQ ID NO: 979 - RNA, 19 nt, Homo sapiens
ugcaucugccccugccgcg

SEQ ID NO: 980 - RNA, 19 nt, Homo sapiens
gcaucugccccugccgcgc

SEQ ID NO: 981 - RNA, 19 nt, Homo sapiens
caucugccccugccgcgcg

SEQ ID NO: 982 - RNA, 19 nt, Homo sapiens
aucugccccugccgcgcgg

SEQ ID NO: 983 - RNA, 19 nt, Homo sapiens
ucugccccugccgcgcgga

SEQ ID NO: 984 - RNA, 19 nt, Homo sapiens
cugccccugccgcgcggag

SEQ ID NO: 985 - RNA, 19 nt, Homo sapiens
ugccccugccgcgcggagg

SEQ ID NO: 986 - RNA, 19 nt, Homo sapiens
gccccugccgcgcggaggc

SEQ ID NO: 987 - RNA, 19 nt, Homo sapiens
ccccugccgcgcggaggcg

SEQ ID NO: 988 - RNA, 19 nt, Homo sapiens
cccugccgcgcggaggcgg

SEQ ID NO: 989 - RNA, 19 nt, Homo sapiens
ccugccgcgcggaggcgga

SEQ ID NO: 990 - RNA, 19 nt, Homo sapiens
cugccgcgcggaggcggag

SEQ ID NO: 991 - RNA, 19 nt, Homo sapiens
ugccgcgcggaggcggagg

SEQ ID NO: 992 - RNA, 19 nt, Homo sapiens
gccgcgcggaggcggaggc

SEQ ID NO: 993 - RNA, 19 nt, Homo sapiens
ccgcgcggaggcggaggcg

SEQ ID NO: 994 - RNA, 19 nt, Homo sapiens
cgcgcggaggcggaggcgu

SEQ ID NO: 995 - RNA, 19 nt, Homo sapiens
gcgcggaggcggaggcguc

SEQ ID NO: 996 - RNA, 19 nt, Homo sapiens
cgcggaggcggaggcgucc

SEQ ID NO: 997 - RNA, 19 nt, Homo sapiens
gcggaggcggaggcguccg

SEQ ID NO: 998 - RNA, 19 nt, Homo sapiens
cggaggcggaggcguccgg

SEQ ID NO: 999 - RNA, 19 nt, Homo sapiens
ggaggcggaggcguccggg

SEQ ID NO: 1000 - RNA, 19 nt, Homo sapiens
gaggcggaggcguccgggg

SEQ ID NO: 1001 - RNA, 19 nt, Homo sapiens
aggcggaggcguccggggg

SEQ ID NO: 1002 - RNA, 19 nt, Homo sapiens
ggcggaggcguccgggggc

SEQ ID NO: 1003 - RNA, 19 nt, Homo sapiens
gcggaggcguccgggggcg

SEQ ID NO: 1004 - RNA, 19 nt, Homo sapiens
cggaggcguccgggggcgc

SEQ ID NO: 1005 - RNA, 19 nt, Homo sapiens
ggaggcguccgggggcgcg

SEQ ID NO: 1006 - RNA, 19 nt, Homo sapiens
gaggcguccgggggcgcgg

SEQ ID NO: 1007 - RNA, 19 nt, Homo sapiens
aggcguccgggggcgcggg

SEQ ID NO: 1008 - RNA, 19 nt, Homo sapiens
ggcguccgggggcgcgggc

SEQ ID NO: 1009 - RNA, 19 nt, Homo sapiens
gcguccgggggcgcgggcu

SEQ ID NO: 1010 - RNA, 19 nt, Homo sapiens
cguccgggggcgcgggcug

SEQ ID NO: 1011 - RNA, 19 nt, Homo sapiens
guccgggggcgcgggcugg

SEQ ID NO: 1012 - RNA, 19 nt, Homo sapiens
uccgggggcgcgggcuggg

SEQ ID NO: 1013 - RNA, 19 nt, Homo sapiens
ccgggggcgcgggcugggg

SEQ ID NO: 1014 - RNA, 19 nt, Homo sapiens
cgggggcgcgggcugggga

SEQ ID NO: 1015 - RNA, 19 nt, Homo sapiens
gggggcgcgggcuggggag

SEQ ID NO: 1016 - RNA, 19 nt, Homo sapiens
ggggcgcgggcuggggagg

SEQ ID NO: 1017 - RNA, 19 nt, Homo sapiens
gggcgcgggcuggggaggu

SEQ ID NO: 1018 - RNA, 19 nt, Homo sapiens
ggcgcgggcuggggaggug

SEQ ID NO: 1019 - RNA, 19 nt, Homo sapiens
gcgcgggcuggggaggugg

SEQ ID NO: 1020 - RNA, 19 nt, Homo sapiens
cgcgggcuggggaggugga

SEQ ID NO: 1021 - RNA, 19 nt, Homo sapiens
gcgggcuggggagguggag

SEQ ID NO: 1022 - RNA, 19 nt, Homo sapiens
cgggcuggggagguggagc

SEQ ID NO: 1023 - RNA, 19 nt, Homo sapiens
gggcuggggagguggagcu

SEQ ID NO: 1024 - RNA, 19 nt, Homo sapiens
ggcuggggagguggagcug

SEQ ID NO: 1025 - RNA, 19 nt, Homo sapiens
gcuggggagguggagcugc

SEQ ID NO: 1026 - RNA, 19 nt, Homo sapiens
cuggggagguggagcugcc

SEQ ID NO: 1027 - RNA, 19 nt, Homo sapiens
uggggagguggagcugccc

SEQ ID NO: 1028 - RNA, 19 nt, Homo sapiens
ggggagguggagcugcccc

SEQ ID NO: 1029 - RNA, 19 nt, Homo sapiens
gggagguggagcugccccg

SEQ ID NO: 1030 - RNA, 19 nt, Homo sapiens
ggagguggagcugccccgg

SEQ ID NO: 1031 - RNA, 19 nt, Homo sapiens
gagguggagcugccccggc

SEQ ID NO: 1032 - RNA, 19 nt, Homo sapiens
agguggagcugccccggcu

SEQ ID NO: 1033 - RNA, 19 nt, Homo sapiens
gguggagcugccccggcuu

SEQ ID NO: 1034 - RNA, 19 nt, Homo sapiens
guggagcugccccggcuug

SEQ ID NO: 1035 - RNA, 19 nt, Homo sapiens
uggagcugccccggcuugg

SEQ ID NO: 1036 - RNA, 19 nt, Homo sapiens
ggagcugccccggcuuggg

SEQ ID NO: 1037 - RNA, 19 nt, Homo sapiens
gagcugccccggcuugggg

SEQ ID NO: 1038 - RNA, 19 nt, Homo sapiens
agcugccccggcuuggggu

SEQ ID NO: 1039 - RNA, 19 nt, Homo sapiens
gcugccccggcuugggguu

SEQ ID NO: 1040 - RNA, 19 nt, Homo sapiens
cugccccggcuugggguuc

SEQ ID NO: 1041 - RNA, 19 nt, Homo sapiens
ugccccggcuugggguucc

SEQ ID NO: 1042 - RNA, 19 nt, Homo sapiens
gccccggcuugggguuccc

SEQ ID NO: 1043 - RNA, 19 nt, Homo sapiens
ccccggcuugggguuccca

SEQ ID NO: 1044 - RNA, 19 nt, Homo sapiens
cccggcuugggguucccac

SEQ ID NO: 1045 - RNA, 19 nt, Homo sapiens
ccggcuugggguucccacg

SEQ ID NO: 1046 - RNA, 19 nt, Homo sapiens
cggcuugggguucccacgc

SEQ ID NO: 1047 - RNA, 19 nt, Homo sapiens
ggcuugggguucccacgcc

SEQ ID NO: 1048 - RNA, 19 nt, Homo sapiens
gcuugggguucccacgccg

SEQ ID NO: 1049 - RNA, 19 nt, Homo sapiens
cuugggguucccacgccgc

SEQ ID NO: 1050 - RNA, 19 nt, Homo sapiens
uugggguucccacgccgcc

SEQ ID NO: 1051 - RNA, 19 nt, Homo sapiens
ugggguucccacgccgccc

SEQ ID NO: 1052 - RNA, 19 nt, Homo sapiens
gggguucccacgccgcccc

SEQ ID NO: 1053 - RNA, 19 nt, Homo sapiens
ggguucccacgccgccccg

SEQ ID NO: 1054 - RNA, 19 nt, Homo sapiens
gguucccacgccgccccgg

SEQ ID NO: 1055 - RNA, 19 nt, Homo sapiens
guucccacgccgccccggc

SEQ ID NO: 1056 - RNA, 19 nt, Homo sapiens
uucccacgccgccccggcg

SEQ ID NO: 1057 - RNA, 19 nt, Homo sapiens
ucccacgccgccccggcga

SEQ ID NO: 1058 - RNA, 19 nt, Homo sapiens
cccacgccgccccggcgac

SEQ ID NO: 1059 - RNA, 19 nt, Homo sapiens
ccacgccgccccggcgacc

SEQ ID NO: 1060 - RNA, 19 nt, Homo sapiens
cacgccgccccggcgaccu

SEQ ID NO: 1061 - RNA, 19 nt, Homo sapiens
acgccgccccggcgaccug

SEQ ID NO: 1062 - RNA, 19 nt, Homo sapiens
cgccgccccggcgaccugg

SEQ ID NO: 1063 - RNA, 19 nt, Homo sapiens
gccgccccggcgaccuggg

SEQ ID NO: 1064 - RNA, 19 nt, Homo sapiens
ccgccccggcgaccugggg

SEQ ID NO: 1065 - RNA, 19 nt, Homo sapiens
cgccccggcgaccugggga

SEQ ID NO: 1066 - RNA, 19 nt, Homo sapiens
gccccggcgaccuggggac

SEQ ID NO: 1067 - RNA, 19 nt, Homo sapiens
ccccggcgaccuggggacc

SEQ ID NO: 1068 - RNA, 19 nt, Homo sapiens
cccggcgaccuggggaccc

SEQ ID NO: 1069 - RNA, 19 nt, Homo sapiens
ccggcgaccuggggacccc

SEQ ID NO: 1070 - RNA, 19 nt, Homo sapiens
cggcgaccuggggaccccg

SEQ ID NO: 1071 - RNA, 19 nt, Homo sapiens
ggcgaccuggggaccccgg

SEQ ID NO: 1072 - RNA, 19 nt, Homo sapiens
gcgaccuggggaccccggc

SEQ ID NO: 1073 - RNA, 19 nt, Homo sapiens
cgaccuggggaccccggcc

SEQ ID NO: 1074 - RNA, 19 nt, Homo sapiens
gaccuggggaccccggccc

SEQ ID NO: 1075 - RNA, 19 nt, Homo sapiens
accuggggaccccggcccc

SEQ ID NO: 1076 - RNA, 19 nt, Homo sapiens
ccuggggaccccggcccca

SEQ ID NO: 1077 - RNA, 19 nt, Homo sapiens
cuggggaccccggccccag

SEQ ID NO: 1078 - RNA, 19 nt, Homo sapiens
uggggaccccggccccagc

SEQ ID NO: 1079 - RNA, 19 nt, Homo sapiens
ggggaccccggccccagcc

SEQ ID NO: 1080 - RNA, 19 nt, Homo sapiens
gggaccccggccccagccc

SEQ ID NO: 1081 - RNA, 19 nt, Homo sapiens
ggaccccggccccagcccc

SEQ ID NO: 1082 - RNA, 19 nt, Homo sapiens
gaccccggccccagcccca

SEQ ID NO: 1083 - RNA, 19 nt, Homo sapiens
accccggccccagccccac

SEQ ID NO: 1084 - RNA, 19 nt, Homo sapiens
ccccggccccagccccacc

SEQ ID NO: 1085 - RNA, 19 nt, Homo sapiens
cccggccccagccccacca

SEQ ID NO: 1086 - RNA, 19 nt, Homo sapiens
ccggccccagccccaccac

SEQ ID NO: 1087 - RNA, 19 nt, Homo sapiens
cggccccagccccaccacg

SEQ ID NO: 1088 - RNA, 19 nt, Homo sapiens
ggccccagccccaccacgg

SEQ ID NO: 1089 - RNA, 19 nt, Homo sapiens
gccccagccccaccacgga

SEQ ID NO: 1090 - RNA, 19 nt, Homo sapiens
ccccagccccaccacggac

SEQ ID NO: 1091 - RNA, 19 nt, Homo sapiens
cccagccccaccacggacu

SEQ ID NO: 1092 - RNA, 19 nt, Homo sapiens
ccagccccaccacggacuc

SEQ ID NO: 1093 - RNA, 19 nt, Homo sapiens
cagccccaccacggacucc

SEQ ID NO: 1094 - RNA, 19 nt, Homo sapiens
agccccaccacggacuccc

SEQ ID NO: 1095 - RNA, 19 nt, Homo sapiens
gccccaccacggacucccc

SEQ ID NO: 1096 - RNA, 19 nt, Homo sapiens
ccccaccacggacuccccu

SEQ ID NO: 1097 - RNA, 19 nt, Homo sapiens
cccaccacggacuccccug

SEQ ID NO: 1098 - RNA, 19 nt, Homo sapiens
ccaccacggacuccccugg

SEQ ID NO: 1099 - RNA, 19 nt, Homo sapiens
caccacggacuccccuggg

SEQ ID NO: 1100 - RNA, 19 nt, Homo sapiens
accacggacuccccuggga

SEQ ID NO: 1101 - RNA, 19 nt, Homo sapiens
ccacggacuccccugggac

SEQ ID NO: 1102 - RNA, 19 nt, Homo sapiens
cacggacuccccugggacg

SEQ ID NO: 1103 - RNA, 19 nt, Homo sapiens
acggacuccccugggacgu

SEQ ID NO: 1104 - RNA, 19 nt, Homo sapiens
cggacuccccugggacgug

SEQ ID NO: 1105 - RNA, 19 nt, Homo sapiens
ggacuccccugggacgugg

SEQ ID NO: 1106 - RNA, 19 nt, Homo sapiens
gacuccccugggacguggg

SEQ ID NO: 1107 - RNA, 19 nt, Homo sapiens
acuccccugggacgugggu

SEQ ID NO: 1108 - RNA, 19 nt, Homo sapiens
cuccccugggacgugggug

SEQ ID NO: 1109 - RNA, 19 nt, Homo sapiens
uccccugggacgugggugg

SEQ ID NO: 1110 - RNA, 19 nt, Homo sapiens
ccccugggacguggguggc

SEQ ID NO: 1111 - RNA, 19 nt, Homo sapiens
cccugggacguggguggcg

SEQ ID NO: 1112 - RNA, 19 nt, Homo sapiens
ccugggacguggguggcgc

SEQ ID NO: 1113 - RNA, 19 nt, Homo sapiens
cugggacguggguggcgca

SEQ ID NO: 1114 - RNA, 19 nt, Homo sapiens
ugggacguggguggcgcaa

SEQ ID NO: 1115 - RNA, 19 nt, Homo sapiens
gggacguggguggcgcaag

SEQ ID NO: 1116 - RNA, 19 nt, Homo sapiens
ggacguggguggcgcaagc

SEQ ID NO: 1117 - RNA, 19 nt, Homo sapiens
gacguggguggcgcaagca

SEQ ID NO: 1118 - RNA, 19 nt, Homo sapiens
acguggguggcgcaagcac

SEQ ID NO: 1119 - RNA, 19 nt, Homo sapiens
cguggguggcgcaagcacc

SEQ ID NO: 1120 - RNA, 19 nt, Homo sapiens
guggguggcgcaagcaccc

SEQ ID NO: 1121 - RNA, 19 nt, Homo sapiens
uggguggcgcaagcacccc

SEQ ID NO: 1122 - RNA, 19 nt, Homo sapiens
ggguggcgcaagcaccccu

SEQ ID NO: 1123 - RNA, 19 nt, Homo sapiens
gguggcgcaagcaccccuu

SEQ ID NO: 1124 - RNA, 19 nt, Homo sapiens
guggcgcaagcaccccuug

SEQ ID NO: 1125 - RNA, 19 nt, Homo sapiens
uggcgcaagcaccccuugg

SEQ ID NO: 1126 - RNA, 19 nt, Homo sapiens
ggcgcaagcaccccuuggc

SEQ ID NO: 1127 - RNA, 19 nt, Homo sapiens
gcgcaagcaccccuuggcc

SEQ ID NO: 1128 - RNA, 19 nt, Homo sapiens
cgcaagcaccccuuggccc

SEQ ID NO: 1129 - RNA, 19 nt, Homo sapiens
gcaagcaccccuuggcccu

SEQ ID NO: 1130 - RNA, 19 nt, Homo sapiens
caagcaccccuuggcccug

SEQ ID NO: 1131 - RNA, 19 nt, Homo sapiens
aagcaccccuuggcccugc

SEQ ID NO: 1132 - RNA, 19 nt, Homo sapiens
agcaccccuuggcccugcg

SEQ ID NO: 1133 - RNA, 19 nt, Homo sapiens
gcaccccuuggcccugcgg

SEQ ID NO: 1134 - RNA, 19 nt, Homo sapiens
caccccuuggcccugcggc

SEQ ID NO: 1135 - RNA, 19 nt, Homo sapiens
accccuuggcccugcggcc

SEQ ID NO: 1136 - RNA, 19 nt, Homo sapiens
ccccuuggcccugcggccc

SEQ ID NO: 1137 - RNA, 19 nt, Homo sapiens
cccuuggcccugcggcccc

SEQ ID NO: 1138 - RNA, 19 nt, Homo sapiens
ccuuggcccugcggccccg

SEQ ID NO: 1139 - RNA, 19 nt, Homo sapiens
cuuggcccugcggccccgc

SEQ ID NO: 1140 - RNA, 19 nt, Homo sapiens
uuggcccugcggccccgcu

SEQ ID NO: 1141 - RNA, 19 nt, Homo sapiens
uggcccugcggccccgcuu

SEQ ID NO: 1142 - RNA, 19 nt, Homo sapiens
ggcccugcggccccgcuug

SEQ ID NO: 1143 - RNA, 19 nt, Homo sapiens
gcccugcggccccgcuuga

SEQ ID NO: 1144 - RNA, 19 nt, Homo sapiens
cccugcggccccgcuugag

SEQ ID NO: 1145 - RNA, 19 nt, Homo sapiens
ccugcggccccgcuugagc

SEQ ID NO: 1146 - RNA, 19 nt, Homo sapiens
cugcggccccgcuugagcg

SEQ ID NO: 1147 - RNA, 19 nt, Homo sapiens
ugcggccccgcuugagcgg

SEQ ID NO: 1148 - RNA, 19 nt, Homo sapiens
gcggccccgcuugagcggg

SEQ ID NO: 1149 - RNA, 19 nt, Homo sapiens
cggccccgcuugagcgggc

SEQ ID NO: 1150 - RNA, 19 nt, Homo sapiens
ggccccgcuugagcgggcc

SEQ ID NO: 1151 - RNA, 19 nt, Homo sapiens
gccccgcuugagcgggccc

SEQ ID NO: 1152 - RNA, 19 nt, Homo sapiens
ccccgcuugagcgggccca

SEQ ID NO: 1153 - RNA, 19 nt, Homo sapiens
cccgcuugagcgggcccag

SEQ ID NO: 1154 - RNA, 19 nt, Homo sapiens
ccgcuugagcgggcccagg

SEQ ID NO: 1155 - RNA, 19 nt, Homo sapiens
cgcuugagcgggcccaggc

SEQ ID NO: 1156 - RNA, 19 nt, Homo sapiens
gcuugagcgggcccaggcu

SEQ ID NO: 1157 - RNA, 19 nt, Homo sapiens
cuugagcgggcccaggcug

SEQ ID NO: 1158 - RNA, 19 nt, Homo sapiens
uugagcgggcccaggcugu

SEQ ID NO: 1159 - RNA, 19 nt, Homo sapiens
ugagcgggcccaggcugug

SEQ ID NO: 1160 - RNA, 19 nt, Homo sapiens
gagcgggcccaggcugugc

SEQ ID NO: 1161 - RNA, 19 nt, Homo sapiens
agcgggcccaggcugugcc

SEQ ID NO: 1162 - RNA, 19 nt, Homo sapiens
gcgggcccaggcugugcca

SEQ ID NO: 1163 - RNA, 19 nt, Homo sapiens
cgggcccaggcugugccac

SEQ ID NO: 1164 - RNA, 19 nt, Homo sapiens
gggcccaggcugugccacc

SEQ ID NO: 1165 - RNA, 19 nt, Homo sapiens
ggcccaggcugugccaccg

SEQ ID NO: 1166 - RNA, 19 nt, Homo sapiens
gcccaggcugugccaccgc

SEQ ID NO: 1167 - RNA, 19 nt, Homo sapiens
cccaggcugugccaccgcg

SEQ ID NO: 1168 - RNA, 19 nt, Homo sapiens
ccaggcugugccaccgcgc

SEQ ID NO: 1169 - RNA, 19 nt, Homo sapiens
caggcugugccaccgcgca

SEQ ID NO: 1170 - RNA, 19 nt, Homo sapiens
aggcugugccaccgcgcag

SEQ ID NO: 1171 - RNA, 19 nt, Homo sapiens
ggcugugccaccgcgcagg

SEQ ID NO: 1172 - RNA, 19 nt, Homo sapiens
gcugugccaccgcgcaggg

SEQ ID NO: 1173 - RNA, 19 nt, Homo sapiens
cugugccaccgcgcagggg

SEQ ID NO: 1174 - RNA, 19 nt, Homo sapiens
ugugccaccgcgcaggggc

SEQ ID NO: 1175 - RNA, 19 nt, Homo sapiens
gugccaccgcgcaggggcc

SEQ ID NO: 1176 - RNA, 19 nt, Homo sapiens
ugccaccgcgcaggggccc

SEQ ID NO: 1177 - RNA, 19 nt, Homo sapiens
gccaccgcgcaggggcccg

SEQ ID NO: 1178 - RNA, 19 nt, Homo sapiens
ccaccgcgcaggggcccgg

SEQ ID NO: 1179 - RNA, 19 nt, Homo sapiens
caccgcgcaggggcccggc

SEQ ID NO: 1180 - RNA, 19 nt, Homo sapiens
accgcgcaggggcccggca

SEQ ID NO: 1181 - RNA, 19 nt, Homo sapiens
ccgcgcaggggcccggcag

SEQ ID NO: 1182 - RNA, 19 nt, Homo sapiens
cgcgcaggggcccggcagg

SEQ ID NO: 1183 - RNA, 19 nt, Homo sapiens
gcgcaggggcccggcaggc

SEQ ID NO: 1184 - RNA, 19 nt, Homo sapiens
cgcaggggcccggcaggcc

SEQ ID NO: 1185 - RNA, 19 nt, Homo sapiens
gcaggggcccggcaggccg

SEQ ID NO: 1186 - RNA, 19 nt, Homo sapiens
caggggcccggcaggccgu

SEQ ID NO: 1187 - RNA, 19 nt, Homo sapiens
aggggcccggcaggccguc

SEQ ID NO: 1188 - RNA, 19 nt, Homo sapiens
ggggcccggcaggccgucg

SEQ ID NO: 1189 - RNA, 19 nt, Homo sapiens
gggcccggcaggccgucgc

SEQ ID NO: 1190 - RNA, 19 nt, Homo sapiens
ggcccggcaggccgucgcg

SEQ ID NO: 1191 - RNA, 19 nt, Homo sapiens
gcccggcaggccgucgcgc

SEQ ID NO: 1192 - RNA, 19 nt, Homo sapiens
cccggcaggccgucgcgcu

SEQ ID NO: 1193 - RNA, 19 nt, Homo sapiens
ccggcaggccgucgcgcug

SEQ ID NO: 1194 - RNA, 19 nt, Homo sapiens
cggcaggccgucgcgcugc

SEQ ID NO: 1195 - RNA, 19 nt, Homo sapiens
ggcaggccgucgcgcugcg

SEQ ID NO: 1196 - RNA, 19 nt, Homo sapiens
gcaggccgucgcgcugcgg

SEQ ID NO: 1197 - RNA, 19 nt, Homo sapiens
caggccgucgcgcugcggg

SEQ ID NO: 1198 - RNA, 19 nt, Homo sapiens
aggccgucgcgcugcgggu

SEQ ID NO: 1199 - RNA, 19 nt, Homo sapiens
ggccgucgcgcugcggguc

SEQ ID NO: 1200 - RNA, 19 nt, Homo sapiens
gccgucgcgcugcgggucc

SEQ ID NO: 1201 - RNA, 19 nt, Homo sapiens
ccgucgcgcugcggguccc

SEQ ID NO: 1202 - RNA, 19 nt, Homo sapiens
cgucgcgcugcgggucccg

SEQ ID NO: 1203 - RNA, 19 nt, Homo sapiens
gucgcgcugcgggucccgg

SEQ ID NO: 1204 - RNA, 19 nt, Homo sapiens
ucgcgcugcgggucccggu

SEQ ID NO: 1205 - RNA, 19 nt, Homo sapiens
cgcgcugcgggucccgguc

SEQ ID NO: 1206 - RNA, 19 nt, Homo sapiens
gcgcugcgggucccggucc

SEQ ID NO: 1207 - RNA, 19 nt, Homo sapiens
cgcugcgggucccgguccu

SEQ ID NO: 1208 - RNA, 19 nt, Homo sapiens
gcugcgggucccgguccuc

SEQ ID NO: 1209 - RNA, 19 nt, Homo sapiens
cugcgggucccgguccucc

SEQ ID NO: 1210 - RNA, 19 nt, Homo sapiens
ugcgggucccgguccuccc

SEQ ID NO: 1211 - RNA, 19 nt, Homo sapiens
gcgggucccgguccucccg

SEQ ID NO: 1212 - RNA, 19 nt, Homo sapiens
cgggucccgguccucccgg

SEQ ID NO: 1213 - RNA, 19 nt, Homo sapiens
gggucccgguccucccggc

SEQ ID NO: 1214 - RNA, 19 nt, Homo sapiens
ggucccgguccucccggcu

SEQ ID NO: 1215 - RNA, 19 nt, Homo sapiens
gucccgguccucccggcuu

SEQ ID NO: 1216 - RNA, 19 nt, Homo sapiens
ucccgguccucccggcuuu

SEQ ID NO: 1217 - RNA, 19 nt, Homo sapiens
cccgguccucccggcuuuu

SEQ ID NO: 1218 - RNA, 19 nt, Homo sapiens
ccgguccucccggcuuuug

SEQ ID NO: 1219 - RNA, 19 nt, Homo sapiens
cgguccucccggcuuuugc

SEQ ID NO: 1220 - RNA, 19 nt, Homo sapiens
gguccucccggcuuuugcc

SEQ ID NO: 1221 - RNA, 19 nt, Homo sapiens
guccucccggcuuuugccc

SEQ ID NO: 1222 - RNA, 19 nt, Homo sapiens
uccucccggcuuuugcccg

SEQ ID NO: 1223 - RNA, 19 nt, Homo sapiens
ccucccggcuuuugcccgg

SEQ ID NO: 1224 - RNA, 19 nt, Homo sapiens
cucccggcuuuugcccggg

SEQ ID NO: 1225 - RNA, 19 nt, Homo sapiens
ucccggcuuuugcccgggu

SEQ ID NO: 1226 - RNA, 19 nt, Homo sapiens
cccggcuuuugcccgggug

SEQ ID NO: 1227 - RNA, 19 nt, Homo sapiens
ccggcuuuugcccgggugc

SEQ ID NO: 1228 - RNA, 19 nt, Homo sapiens
cggcuuuugcccgggugcg

SEQ ID NO: 1229 - RNA, 19 nt, Homo sapiens
ggcuuuugcccgggugcgg

SEQ ID NO: 1230 - RNA, 19 nt, Homo sapiens
gcuuuugcccgggugcgga

SEQ ID NO: 1231 - RNA, 19 nt, Homo sapiens
cuuuugcccgggugcggag

SEQ ID NO: 1232 - RNA, 19 nt, Homo sapiens
uuuugcccgggugcggagg

SEQ ID NO: 1233 - RNA, 19 nt, Homo sapiens
uuugcccgggugcggaggc

SEQ ID NO: 1234 - RNA, 19 nt, Homo sapiens
uugcccgggugcggaggcc

SEQ ID NO: 1235 - RNA, 19 nt, Homo sapiens
ugcccgggugcggaggcca

SEQ ID NO: 1236 - RNA, 19 nt, Homo sapiens
gcccgggugcggaggccag

SEQ ID NO: 1237 - RNA, 19 nt, Homo sapiens
cccgggugcggaggccagc

SEQ ID NO: 1238 - RNA, 19 nt, Homo sapiens
ccgggugcggaggccagcg

SEQ ID NO: 1239 - RNA, 19 nt, Homo sapiens
cgggugcggaggccagcga

SEQ ID NO: 1240 - RNA, 19 nt, Homo sapiens
gggugcggaggccagcgag

SEQ ID NO: 1241 - RNA, 19 nt, Homo sapiens
ggugcggaggccagcgagg

SEQ ID NO: 1242 - RNA, 19 nt, Homo sapiens
gugcggaggccagcgagga

SEQ ID NO: 1243 - RNA, 19 nt, Homo sapiens
ugcggaggccagcgaggag

SEQ ID NO: 1244 - RNA, 19 nt, Homo sapiens
gcggaggccagcgaggagc

SEQ ID NO: 1245 - RNA, 19 nt, Homo sapiens
cggaggccagcgaggagcc

SEQ ID NO: 1246 - RNA, 19 nt, Homo sapiens
ggaggccagcgaggagccu

SEQ ID NO: 1247 - RNA, 19 nt, Homo sapiens
gaggccagcgaggagccug

SEQ ID NO: 1248 - RNA, 19 nt, Homo sapiens
aggccagcgaggagccuga

SEQ ID NO: 1249 - RNA, 19 nt, Homo sapiens
ggccagcgaggagccugag

SEQ ID NO: 1250 - RNA, 19 nt, Homo sapiens
gccagcgaggagccugagg

SEQ ID NO: 1251 - RNA, 19 nt, Homo sapiens
ccagcgaggagccugaggg

SEQ ID NO: 1252 - RNA, 19 nt, Homo sapiens
cagcgaggagccugagggu

SEQ ID NO: 1253 - RNA, 19 nt, Homo sapiens
agcgaggagccugagggug

SEQ ID NO: 1254 - RNA, 19 nt, Homo sapiens
gcgaggagccugagggugg

SEQ ID NO: 1255 - RNA, 19 nt, Homo sapiens
cgaggagccugaggguggg

SEQ ID NO: 1256 - RNA, 19 nt, Homo sapiens
gaggagccugaggguggga

SEQ ID NO: 1257 - RNA, 19 nt, Homo sapiens
aggagccugagggugggag

SEQ ID NO: 1258 - RNA, 19 nt, Homo sapiens
ggagccugagggugggaga

SEQ ID NO: 1259 - RNA, 19 nt, Homo sapiens
gagccugagggugggagag

SEQ ID NO: 1260 - RNA, 19 nt, Homo sapiens
agccugagggugggagagc

SEQ ID NO: 1261 - RNA, 19 nt, Homo sapiens
gccugagggugggagagcg

SEQ ID NO: 1262 - RNA, 19 nt, Homo sapiens
ccugagggugggagagcgc

SEQ ID NO: 1263 - RNA, 19 nt, Homo sapiens
cugagggugggagagcgcc

SEQ ID NO: 1264 - RNA, 19 nt, Homo sapiens
ugagggugggagagcgccc

SEQ ID NO: 1265 - RNA, 19 nt, Homo sapiens
gagggugggagagcgcccc

SEQ ID NO: 1266 - RNA, 19 nt, Homo sapiens
agggugggagagcgccccg

SEQ ID NO: 1267 - RNA, 19 nt, Homo sapiens
gggugggagagcgccccgu

SEQ ID NO: 1268 - RNA, 19 nt, Homo sapiens
ggugggagagcgccccguc

SEQ ID NO: 1269 - RNA, 19 nt, Homo sapiens
gugggagagcgccccgucc

SEQ ID NO: 1270 - RNA, 19 nt, Homo sapiens
ugggagagcgccccguccg

SEQ ID NO: 1271 - RNA, 19 nt, Homo sapiens
gggagagcgccccguccgg

SEQ ID NO: 1272 - RNA, 19 nt, Homo sapiens
ggagagcgccccguccgga

SEQ ID NO: 1273 - RNA, 19 nt, Homo sapiens
gagagcgccccguccggag

SEQ ID NO: 1274 - RNA, 19 nt, Homo sapiens
agagcgccccguccggagg

SEQ ID NO: 1275 - RNA, 19 nt, Homo sapiens
gagcgccccguccggagga

SEQ ID NO: 1276 - RNA, 19 nt, Homo sapiens
agcgccccguccggaggag

SEQ ID NO: 1277 - RNA, 19 nt, Homo sapiens
gcgccccguccggaggagc

SEQ ID NO: 1278 - RNA, 19 nt, Homo sapiens
cgccccguccggaggagcc

SEQ ID NO: 1279 - RNA, 19 nt, Homo sapiens
gccccguccggaggagccg

SEQ ID NO: 1280 - RNA, 19 nt, Homo sapiens
ccccguccggaggagccgg

SEQ ID NO: 1281 - RNA, 19 nt, Homo sapiens
cccguccggaggagccggg

SEQ ID NO: 1282 - RNA, 19 nt, Homo sapiens
ccguccggaggagccgggg

SEQ ID NO: 1283 - RNA, 19 nt, Homo sapiens
cguccggaggagccggggc

SEQ ID NO: 1284 - RNA, 19 nt, Homo sapiens
guccggaggagccggggcg

SEQ ID NO: 1285 - RNA, 19 nt, Homo sapiens
uccggaggagccggggcgg

SEQ ID NO: 1286 - RNA, 19 nt, Homo sapiens
ccggaggagccggggcggc

SEQ ID NO: 1287 - RNA, 19 nt, Homo sapiens
cggaggagccggggcggcg

SEQ ID NO: 1288 - RNA, 19 nt, Homo sapiens
ggaggagccggggcggcgu

SEQ ID NO: 1289 - RNA, 19 nt, Homo sapiens
gaggagccggggcggcgua

SEQ ID NO: 1290 - RNA, 19 nt, Homo sapiens
aggagccggggcggcguag

SEQ ID NO: 1291 - RNA, 19 nt, Homo sapiens
ggagccggggcggcguagg

SEQ ID NO: 1292 - RNA, 19 nt, Homo sapiens
gagccggggcggcguaggc

SEQ ID NO: 1293 - RNA, 19 nt, Homo sapiens
agccggggcggcguaggcg

SEQ ID NO: 1294 - RNA, 19 nt, Homo sapiens
gccggggcggcguaggcga

SEQ ID NO: 1295 - RNA, 19 nt, Homo sapiens
ccggggcggcguaggcgaa

SEQ ID NO: 1296 - RNA, 19 nt, Homo sapiens
cggggcggcguaggcgaaa

SEQ ID NO: 1297 - RNA, 19 nt, Homo sapiens
ggggcggcguaggcgaaau

SEQ ID NO: 1298 - RNA, 19 nt, Homo sapiens
gggcggcguaggcgaaauc

SEQ ID NO: 1299 - RNA, 19 nt, Homo sapiens
ggcggcguaggcgaaaucc

SEQ ID NO: 1300 - RNA, 19 nt, Homo sapiens
gcggcguaggcgaaauccc

SEQ ID NO: 1301 - RNA, 19 nt, Homo sapiens
cggcguaggcgaaaucccc

SEQ ID NO: 1302 - RNA, 19 nt, Homo sapiens
ggcguaggcgaaauccccg

SEQ ID NO: 1303 - RNA, 19 nt, Homo sapiens
gcguaggcgaaauccccgc

SEQ ID NO: 1304 - RNA, 19 nt, Homo sapiens
cguaggcgaaauccccgcg

SEQ ID NO: 1305 - RNA, 19 nt, Homo sapiens
guaggcgaaauccccgcgc

SEQ ID NO: 1306 - RNA, 19 nt, Homo sapiens
uaggcgaaauccccgcgcg

SEQ ID NO: 1307 - RNA, 19 nt, Homo sapiens
aggcgaaauccccgcgcgc

SEQ ID NO: 1308 - RNA, 19 nt, Homo sapiens
ggcgaaauccccgcgcgcc

SEQ ID NO: 1309 - RNA, 19 nt, Homo sapiens
gcgaaauccccgcgcgccg

SEQ ID NO: 1310 - RNA, 19 nt, Homo sapiens
cgaaauccccgcgcgccgg

SEQ ID NO: 1311 - RNA, 19 nt, Homo sapiens
gaaauccccgcgcgccggg

SEQ ID NO: 1312 - RNA, 19 nt, Homo sapiens
aaauccccgcgcgccgggg

SEQ ID NO: 1313 - RNA, 19 nt, Homo sapiens
aauccccgcgcgccggggc

SEQ ID NO: 1314 - RNA, 19 nt, Homo sapiens
auccccgcgcgccggggca

SEQ ID NO: 1315 - RNA, 19 nt, Homo sapiens
uccccgcgcgccggggcag

SEQ ID NO: 1316 - RNA, 19 nt, Homo sapiens
ccccgcgcgccggggcagg

SEQ ID NO: 1317 - RNA, 19 nt, Homo sapiens
cccgcgcgccggggcaggu

SEQ ID NO: 1318 - RNA, 19 nt, Homo sapiens
ccgcgcgccggggcagguu

SEQ ID NO: 1319 - RNA, 19 nt, Homo sapiens
cgcgcgccggggcagguug

SEQ ID NO: 1320 - RNA, 19 nt, Homo sapiens
gcgcgccggggcagguugg

SEQ ID NO: 1321 - RNA, 19 nt, Homo sapiens
cgcgccggggcagguuggg

SEQ ID NO: 1322 - RNA, 19 nt, Homo sapiens
gcgccggggcagguuggga

SEQ ID NO: 1323 - RNA, 19 nt, Homo sapiens
cgccggggcagguugggag

SEQ ID NO: 1324 - RNA, 19 nt, Homo sapiens
gccggggcagguugggaga

SEQ ID NO: 1325 - RNA, 19 nt, Homo sapiens
ccggggcagguugggagau

SEQ ID NO: 1326 - RNA, 19 nt, Homo sapiens
cggggcagguugggagauc

SEQ ID NO: 1327 - RNA, 19 nt, Homo sapiens
ggggcagguugggagaucc

SEQ ID NO: 1328 - RNA, 19 nt, Homo sapiens
gggcagguugggagauccc

SEQ ID NO: 1329 - RNA, 19 nt, Homo sapiens
ggcagguugggagaucccc

SEQ ID NO: 1330 - RNA, 19 nt, Homo sapiens
gcagguugggagauccccu

SEQ ID NO: 1331 - RNA, 19 nt, Homo sapiens
cagguugggagauccccuc

SEQ ID NO: 1332 - RNA, 19 nt, Homo sapiens
agguugggagauccccucu

SEQ ID NO: 1333 - RNA, 19 nt, Homo sapiens
gguugggagauccccucug

SEQ ID NO: 1334 - RNA, 19 nt, Homo sapiens
guugggagauccccucugc

SEQ ID NO: 1335 - RNA, 19 nt, Homo sapiens
uugggagauccccucugcc

SEQ ID NO: 1336 - RNA, 19 nt, Homo sapiens
ugggagauccccucugccg

SEQ ID NO: 1337 - RNA, 19 nt, Homo sapiens
gggagauccccucugccgg

SEQ ID NO: 1338 - RNA, 19 nt, Homo sapiens
ggagauccccucugccggc

SEQ ID NO: 1339 - RNA, 19 nt, Homo sapiens
gagauccccucugccggcg

SEQ ID NO: 1340 - RNA, 19 nt, Homo sapiens
agauccccucugccggcgc

SEQ ID NO: 1341 - RNA, 19 nt, Homo sapiens
gauccccucugccggcgcg

SEQ ID NO: 1342 - RNA, 19 nt, Homo sapiens
auccccucugccggcgcgg

SEQ ID NO: 1343 - RNA, 19 nt, Homo sapiens
uccccucugccggcgcggc

SEQ ID NO: 1344 - RNA, 19 nt, Homo sapiens
ccccucugccggcgcggcc

SEQ ID NO: 1345 - RNA, 19 nt, Homo sapiens
cccucugccggcgcggccu

SEQ ID NO: 1346 - RNA, 19 nt, Homo sapiens
ccucugccggcgcggccug

SEQ ID NO: 1347 - RNA, 19 nt, Homo sapiens
cucugccggcgcggccugg

SEQ ID NO: 1348 - RNA, 19 nt, Homo sapiens
ucugccggcgcggccuggc

SEQ ID NO: 1349 - RNA, 19 nt, Homo sapiens
cugccggcgcggccuggcu

SEQ ID NO: 1350 - RNA, 19 nt, Homo sapiens
ugccggcgcggccuggcug

SEQ ID NO: 1351 - RNA, 19 nt, Homo sapiens
gccggcgcggccuggcugg

SEQ ID NO: 1352 - RNA, 19 nt, Homo sapiens
ccggcgcggccuggcuggg

SEQ ID NO: 1353 - RNA, 19 nt, Homo sapiens
cggcgcggccuggcugggc

SEQ ID NO: 1354 - RNA, 19 nt, Homo sapiens
ggcgcggccuggcugggcu

SEQ ID NO: 1355 - RNA, 19 nt, Homo sapiens
gcgcggccuggcugggcug

SEQ ID NO: 1356 - RNA, 19 nt, Homo sapiens
cgcggccuggcugggcugc

SEQ ID NO: 1357 - RNA, 19 nt, Homo sapiens
gcggccuggcugggcugca

SEQ ID NO: 1358 - RNA, 19 nt, Homo sapiens
cggccuggcugggcugcag

SEQ ID NO: 1359 - RNA, 19 nt, Homo sapiens
ggccuggcugggcugcagc

SEQ ID NO: 1360 - RNA, 19 nt, Homo sapiens
gccuggcugggcugcagcg

SEQ ID NO: 1361 - RNA, 19 nt, Homo sapiens
ccuggcugggcugcagcgc

SEQ ID NO: 1362 - RNA, 19 nt, Homo sapiens
cuggcugggcugcagcgcg

SEQ ID NO: 1363 - RNA, 19 nt, Homo sapiens
uggcugggcugcagcgcgg

SEQ ID NO: 1364 - RNA, 19 nt, Homo sapiens
ggcugggcugcagcgcggg

SEQ ID NO: 1365 - RNA, 19 nt, Homo sapiens
gcugggcugcagcgcgggg

SEQ ID NO: 1366 - RNA, 19 nt, Homo sapiens
cugggcugcagcgcggggg

SEQ ID NO: 1367 - RNA, 19 nt, Homo sapiens
ugggcugcagcgcgggggc

SEQ ID NO: 1368 - RNA, 19 nt, Homo sapiens
gggcugcagcgcgggggcg

SEQ ID NO: 1369 - RNA, 19 nt, Homo sapiens
ggcugcagcgcgggggcgg

SEQ ID NO: 1370 - RNA, 19 nt, Homo sapiens
gcugcagcgcgggggcggc

SEQ ID NO: 1371 - RNA, 19 nt, Homo sapiens
cugcagcgcgggggcggcc

SEQ ID NO: 1372 - RNA, 19 nt, Homo sapiens
ugcagcgcgggggcggccc

SEQ ID NO: 1373 - RNA, 19 nt, Homo sapiens
gcagcgcgggggcggcccu

SEQ ID NO: 1374 - RNA, 19 nt, Homo sapiens
cagcgcgggggcggcccuc

SEQ ID NO: 1375 - RNA, 19 nt, Homo sapiens
agcgcgggggcggcccucg

SEQ ID NO: 1376 - RNA, 19 nt, Homo sapiens
gcgcgggggcggcccucgc

SEQ ID NO: 1377 - RNA, 19 nt, Homo sapiens
cgcgggggcggcccucgcu

SEQ ID NO: 1378 - RNA, 19 nt, Homo sapiens
gcgggggcggcccucgcug

SEQ ID NO: 1379 - RNA, 19 nt, Homo sapiens
cgggggcggcccucgcugc

SEQ ID NO: 1380 - RNA, 19 nt, Homo sapiens
gggggcggcccucgcugcc

SEQ ID NO: 1381 - RNA, 19 nt, Homo sapiens
ggggcggcccucgcugccu

SEQ ID NO: 1382 - RNA, 19 nt, Homo sapiens
gggcggcccucgcugccug

SEQ ID NO: 1383 - RNA, 19 nt, Homo sapiens
ggcggcccucgcugccugg

SEQ ID NO: 1384 - RNA, 19 nt, Homo sapiens
gcggcccucgcugccuggc

SEQ ID NO: 1385 - RNA, 19 nt, Homo sapiens
cggcccucgcugccuggcu

SEQ ID NO: 1386 - RNA, 19 nt, Homo sapiens
ggcccucgcugccuggcuc

SEQ ID NO: 1387 - RNA, 19 nt, Homo sapiens
gcccucgcugccuggcuca

SEQ ID NO: 1388 - RNA, 19 nt, Homo sapiens
cccucgcugccuggcucac

SEQ ID NO: 1389 - RNA, 19 nt, Homo sapiens
ccucgcugccuggcucacg

SEQ ID NO: 1390 - RNA, 19 nt, Homo sapiens
cucgcugccuggcucacga

SEQ ID NO: 1391 - RNA, 19 nt, Homo sapiens
ucgcugccuggcucacgaa

SEQ ID NO: 1392 - RNA, 19 nt, Homo sapiens
cgcugccuggcucacgaaa

SEQ ID NO: 1393 - RNA, 19 nt, Homo sapiens
gcugccuggcucacgaaag

SEQ ID NO: 1394 - RNA, 19 nt, Homo sapiens
cugccuggcucacgaaagc

SEQ ID NO: 1395 - RNA, 19 nt, Homo sapiens
ugccuggcucacgaaagcc

SEQ ID NO: 1396 - RNA, 19 nt, Homo sapiens
gccuggcucacgaaagccc

SEQ ID NO: 1397 - RNA, 19 nt, Homo sapiens
ccuggcucacgaaagcccc

SEQ ID NO: 1398 - RNA, 19 nt, Homo sapiens
cuggcucacgaaagccccc

SEQ ID NO: 1399 - RNA, 19 nt, Homo sapiens
uggcucacgaaagcccccu

SEQ ID NO: 1400 - RNA, 19 nt, Homo sapiens
ggcucacgaaagcccccug

SEQ ID NO: 1401 - RNA, 19 nt, Homo sapiens
gcucacgaaagcccccugu

SEQ ID NO: 1402 - RNA, 19 nt, Homo sapiens
cucacgaaagcccccugug

SEQ ID NO: 1403 - RNA, 19 nt, Homo sapiens
ucacgaaagcccccugugg

SEQ ID NO: 1404 - RNA, 19 nt, Homo sapiens
cacgaaagcccccuguggg

SEQ ID NO: 1405 - RNA, 19 nt, Homo sapiens
acgaaagcccccuguggga

SEQ ID NO: 1406 - RNA, 19 nt, Homo sapiens
cgaaagcccccugugggag

SEQ ID NO: 1407 - RNA, 19 nt, Homo sapiens
gaaagcccccugugggaga

SEQ ID NO: 1408 - RNA, 19 nt, Homo sapiens
aaagcccccugugggagag

SEQ ID NO: 1409 - RNA, 19 nt, Homo sapiens
aagcccccugugggagagc

SEQ ID NO: 1410 - RNA, 19 nt, Homo sapiens
agcccccugugggagagcc

SEQ ID NO: 1411 - RNA, 19 nt, Homo sapiens
gcccccugugggagagccc

SEQ ID NO: 1412 - RNA, 19 nt, Homo sapiens
cccccugugggagagcccc

SEQ ID NO: 1413 - RNA, 19 nt, Homo sapiens
ccccugugggagagcccca

SEQ ID NO: 1414 - RNA, 19 nt, Homo sapiens
cccugugggagagccccag

SEQ ID NO: 1415 - RNA, 19 nt, Homo sapiens
ccugugggagagccccagg

SEQ ID NO: 1416 - RNA, 19 nt, Homo sapiens
cugugggagagccccaggc

SEQ ID NO: 1417 - RNA, 19 nt, Homo sapiens
ugugggagagccccaggcg

SEQ ID NO: 1418 - RNA, 19 nt, Homo sapiens
gugggagagccccaggcgc

SEQ ID NO: 1419 - RNA, 19 nt, Homo sapiens
ugggagagccccaggcgcg

SEQ ID NO: 1420 - RNA, 19 nt, Homo sapiens
gggagagccccaggcgcgc

SEQ ID NO: 1421 - RNA, 19 nt, Homo sapiens
ggagagccccaggcgcgca

SEQ ID NO: 1422 - RNA, 19 nt, Homo sapiens
gagagccccaggcgcgcag

SEQ ID NO: 1423 - RNA, 19 nt, Homo sapiens
agagccccaggcgcgcagg

SEQ ID NO: 1424 - RNA, 19 nt, Homo sapiens
gagccccaggcgcgcaggg

SEQ ID NO: 1425 - RNA, 19 nt, Homo sapiens
agccccaggcgcgcagggc

SEQ ID NO: 1426 - RNA, 19 nt, Homo sapiens
gccccaggcgcgcagggca

SEQ ID NO: 1427 - RNA, 19 nt, Homo sapiens
ccccaggcgcgcagggcac

SEQ ID NO: 1428 - RNA, 19 nt, Homo sapiens
cccaggcgcgcagggcacg

SEQ ID NO: 1429 - RNA, 19 nt, Homo sapiens
ccaggcgcgcagggcacgu

SEQ ID NO: 1430 - RNA, 19 nt, Homo sapiens
caggcgcgcagggcacgug

SEQ ID NO: 1431 - RNA, 19 nt, Homo sapiens
aggcgcgcagggcacgugg

SEQ ID NO: 1432 - RNA, 19 nt, Homo sapiens
ggcgcgcagggcacguggg

SEQ ID NO: 1433 - RNA, 19 nt, Homo sapiens
gcgcgcagggcacgugggg

SEQ ID NO: 1434 - RNA, 19 nt, Homo sapiens
cgcgcagggcacguggggu

SEQ ID NO: 1435 - RNA, 19 nt, Homo sapiens
gcgcagggcacguggggug

SEQ ID NO: 1436 - RNA, 19 nt, Homo sapiens
cgcagggcacguggggugc

SEQ ID NO: 1437 - RNA, 19 nt, Homo sapiens
gcagggcacguggggugcg

SEQ ID NO: 1438 - RNA, 19 nt, Homo sapiens
cagggcacguggggugcgg

SEQ ID NO: 1439 - RNA, 19 nt, Homo sapiens
agggcacguggggugcggg

SEQ ID NO: 1440 - RNA, 19 nt, Homo sapiens
gggcacguggggugcggga

SEQ ID NO: 1441 - RNA, 19 nt, Homo sapiens
ggcacguggggugcgggaa

SEQ ID NO: 1442 - RNA, 19 nt, Homo sapiens
gcacguggggugcgggaag

SEQ ID NO: 1443 - RNA, 19 nt, Homo sapiens
cacguggggugcgggaagc

SEQ ID NO: 1444 - RNA, 19 nt, Homo sapiens
acguggggugcgggaagcc

SEQ ID NO: 1445 - RNA, 19 nt, Homo sapiens
cguggggugcgggaagccc

SEQ ID NO: 1446 - RNA, 19 nt, Homo sapiens
guggggugcgggaagcccc

SEQ ID NO: 1447 - RNA, 19 nt, Homo sapiens
uggggugcgggaagccccg

SEQ ID NO: 1448 - RNA, 19 nt, Homo sapiens
ggggugcgggaagccccgu

SEQ ID NO: 1449 - RNA, 19 nt, Homo sapiens
gggugcgggaagccccguu

SEQ ID NO: 1450 - RNA, 19 nt, Homo sapiens
ggugcgggaagccccguuc

SEQ ID NO: 1451 - RNA, 19 nt, Homo sapiens
gugcgggaagccccguucc

SEQ ID NO: 1452 - RNA, 19 nt, Homo sapiens
ugcgggaagccccguuccc

SEQ ID NO: 1453 - RNA, 19 nt, Homo sapiens
gcgggaagccccguucccc

SEQ ID NO: 1454 - RNA, 19 nt, Homo sapiens
cgggaagccccguucccca

SEQ ID NO: 1455 - RNA, 19 nt, Homo sapiens
gggaagccccguuccccac

SEQ ID NO: 1456 - RNA, 19 nt, Homo sapiens
ggaagccccguuccccacg

SEQ ID NO: 1457 - RNA, 19 nt, Homo sapiens
gaagccccguuccccacgc

SEQ ID NO: 1458 - RNA, 19 nt, Homo sapiens
aagccccguuccccacgcg

SEQ ID NO: 1459 - RNA, 19 nt, Homo sapiens
agccccguuccccacgcgc

SEQ ID NO: 1460 - RNA, 19 nt, Homo sapiens
gccccguuccccacgcgcc

SEQ ID NO: 1461 - RNA, 19 nt, Homo sapiens
ccccguuccccacgcgccg

SEQ ID NO: 1462 - RNA, 19 nt, Homo sapiens
cccguuccccacgcgccgg

SEQ ID NO: 1463 - RNA, 19 nt, Homo sapiens
ccguuccccacgcgccggu

SEQ ID NO: 1464 - RNA, 19 nt, Homo sapiens
cguuccccacgcgccggug

SEQ ID NO: 1465 - RNA, 19 nt, Homo sapiens
guuccccacgcgccggugu

SEQ ID NO: 1466 - RNA, 19 nt, Homo sapiens
uuccccacgcgccggugug

SEQ ID NO: 1467 - RNA, 19 nt, Homo sapiens
uccccacgcgccggugugg

SEQ ID NO: 1468 - RNA, 19 nt, Homo sapiens
ccccacgcgccgguguggg

SEQ ID NO: 1469 - RNA, 19 nt, Homo sapiens
cccacgcgccggugugggc

SEQ ID NO: 1470 - RNA, 19 nt, Homo sapiens
ccacgcgccggugugggcg

SEQ ID NO: 1471 - RNA, 19 nt, Homo sapiens
cacgcgccggugugggcga

SEQ ID NO: 1472 - RNA, 19 nt, Homo sapiens
acgcgccggugugggcgaa

SEQ ID NO: 1473 - RNA, 19 nt, Homo sapiens
cgcgccggugugggcgaag

SEQ ID NO: 1474 - RNA, 19 nt, Homo sapiens
gcgccggugugggcgaagg

SEQ ID NO: 1475 - RNA, 19 nt, Homo sapiens
cgccggugugggcgaaggc

SEQ ID NO: 1476 - RNA, 19 nt, Homo sapiens
gccggugugggcgaaggcg

SEQ ID NO: 1477 - RNA, 19 nt, Homo sapiens
ccggugugggcgaaggcga

SEQ ID NO: 1478 - RNA, 19 nt, Homo sapiens
cggugugggcgaaggcgac

SEQ ID NO: 1479 - RNA, 19 nt, Homo sapiens
ggugugggcgaaggcgacc

SEQ ID NO: 1480 - RNA, 19 nt, Homo sapiens
gugugggcgaaggcgaccc

SEQ ID NO: 1481 - RNA, 19 nt, Homo sapiens
ugugggcgaaggcgaccca

SEQ ID NO: 1482 - RNA, 19 nt, Homo sapiens
gugggcgaaggcgacccac

SEQ ID NO: 1483 - RNA, 19 nt, Homo sapiens
ugggcgaaggcgacccacg

SEQ ID NO: 1484 - RNA, 19 nt, Homo sapiens
gggcgaaggcgacccacga

SEQ ID NO: 1485 - RNA, 19 nt, Homo sapiens
ggcgaaggcgacccacgag

SEQ ID NO: 1486 - RNA, 19 nt, Homo sapiens
gcgaaggcgacccacgagg

SEQ ID NO: 1487 - RNA, 19 nt, Homo sapiens
cgaaggcgacccacgaggg

SEQ ID NO: 1488 - RNA, 19 nt, Homo sapiens
gaaggcgacccacgaggga

SEQ ID NO: 1489 - RNA, 19 nt, Homo sapiens
aaggcgacccacgagggag

SEQ ID NO: 1490 - RNA, 19 nt, Homo sapiens
aggcgacccacgagggagc

SEQ ID NO: 1491 - RNA, 19 nt, Homo sapiens
ggcgacccacgagggagca

SEQ ID NO: 1492 - RNA, 19 nt, Homo sapiens
gcgacccacgagggagcag

SEQ ID NO: 1493 - RNA, 19 nt, Homo sapiens
cgacccacgagggagcagg

SEQ ID NO: 1494 - RNA, 19 nt, Homo sapiens
gacccacgagggagcaggg

SEQ ID NO: 1495 - RNA, 19 nt, Homo sapiens
acccacgagggagcagggu

SEQ ID NO: 1496 - RNA, 19 nt, Homo sapiens
cccacgagggagcagggug

SEQ ID NO: 1497 - RNA, 19 nt, Homo sapiens
ccacgagggagcaggguga

SEQ ID NO: 1498 - RNA, 19 nt, Homo sapiens
cacgagggagcagggugac

SEQ ID NO: 1499 - RNA, 19 nt, Homo sapiens
acgagggagcagggugacc

SEQ ID NO: 1500 - RNA, 19 nt, Homo sapiens
cgagggagcagggugaccc

SEQ ID NO: 1501 - RNA, 19 nt, Homo sapiens
gagggagcagggugacccc

SEQ ID NO: 1502 - RNA, 19 nt, Homo sapiens
agggagcagggugaccccc

SEQ ID NO: 1503 - RNA, 19 nt, Homo sapiens
gggagcagggugacccccg

SEQ ID NO: 1504 - RNA, 19 nt, Homo sapiens
ggagcagggugacccccgc

SEQ ID NO: 1505 - RNA, 19 nt, Homo sapiens
gagcagggugacccccgcc

SEQ ID NO: 1506 - RNA, 19 nt, Homo sapiens
agcagggugacccccgccg

SEQ ID NO: 1507 - RNA, 19 nt, Homo sapiens
gcagggugacccccgccgg

SEQ ID NO: 1508 - RNA, 19 nt, Homo sapiens
cagggugacccccgccggg

SEQ ID NO: 1509 - RNA, 19 nt, Homo sapiens
agggugacccccgccgggg

SEQ ID NO: 1510 - RNA, 19 nt, Homo sapiens
gggugacccccgccggggg

SEQ ID NO: 1511 - RNA, 19 nt, Homo sapiens
ggugacccccgccgggggc

SEQ ID NO: 1512 - RNA, 19 nt, Homo sapiens
gugacccccgccgggggcc

SEQ ID NO: 1513 - RNA, 19 nt, Homo sapiens
ugacccccgccgggggccg

SEQ ID NO: 1514 - RNA, 19 nt, Homo sapiens
gacccccgccgggggccgc

SEQ ID NO: 1515 - RNA, 19 nt, Homo sapiens
acccccgccgggggccgcg

SEQ ID NO: 1516 - RNA, 19 nt, Homo sapiens
cccccgccgggggccgcgc

SEQ ID NO: 1517 - RNA, 19 nt, Homo sapiens
ccccgccgggggccgcgcu

SEQ ID NO: 1518 - RNA, 19 nt, Homo sapiens
cccgccgggggccgcgcug

SEQ ID NO: 1519 - RNA, 19 nt, Homo sapiens
ccgccgggggccgcgcugc

SEQ ID NO: 1520 - RNA, 19 nt, Homo sapiens
cgccgggggccgcgcugca

SEQ ID NO: 1521 - RNA, 19 nt, Homo sapiens
gccgggggccgcgcugcac

SEQ ID NO: 1522 - RNA, 19 nt, Homo sapiens
ccgggggccgcgcugcaca

SEQ ID NO: 1523 - RNA, 19 nt, Homo sapiens
cgggggccgcgcugcacag

SEQ ID NO: 1524 - RNA, 19 nt, Homo sapiens
gggggccgcgcugcacagg

SEQ ID NO: 1525 - RNA, 19 nt, Homo sapiens
ggggccgcgcugcacaggc

SEQ ID NO: 1526 - RNA, 19 nt, Homo sapiens
gggccgcgcugcacaggcc

SEQ ID NO: 1527 - RNA, 19 nt, Homo sapiens
ggccgcgcugcacaggccg

SEQ ID NO: 1528 - RNA, 19 nt, Homo sapiens
gccgcgcugcacaggccgc

SEQ ID NO: 1529 - RNA, 19 nt, Homo sapiens
ccgcgcugcacaggccgcc

SEQ ID NO: 1530 - RNA, 19 nt, Homo sapiens
cgcgcugcacaggccgccu

SEQ ID NO: 1531 - RNA, 19 nt, Homo sapiens
gcgcugcacaggccgccug

SEQ ID NO: 1532 - RNA, 19 nt, Homo sapiens
cgcugcacaggccgccugc

SEQ ID NO: 1533 - RNA, 19 nt, Homo sapiens
gcugcacaggccgccugcc

SEQ ID NO: 1534 - RNA, 19 nt, Homo sapiens
cugcacaggccgccugccu

SEQ ID NO: 1535 - RNA, 19 nt, Homo sapiens
ugcacaggccgccugccug

SEQ ID NO: 1536 - RNA, 19 nt, Homo sapiens
gcacaggccgccugccugc

SEQ ID NO: 1537 - RNA, 19 nt, Homo sapiens
cacaggccgccugccugcg

SEQ ID NO: 1538 - RNA, 19 nt, Homo sapiens
acaggccgccugccugcgc

SEQ ID NO: 1539 - RNA, 19 nt, Homo sapiens
caggccgccugccugcgcg

SEQ ID NO: 1540 - RNA, 19 nt, Homo sapiens
aggccgccugccugcgcgg

SEQ ID NO: 1541 - RNA, 19 nt, Homo sapiens
ggccgccugccugcgcggg

SEQ ID NO: 1542 - RNA, 19 nt, Homo sapiens
gccgccugccugcgcgggc

SEQ ID NO: 1543 - RNA, 19 nt, Homo sapiens
ccgccugccugcgcgggcg

SEQ ID NO: 1544 - RNA, 19 nt, Homo sapiens
cgccugccugcgcgggcgc

SEQ ID NO: 1545 - RNA, 19 nt, Homo sapiens
gccugccugcgcgggcgcc

SEQ ID NO: 1546 - RNA, 19 nt, Homo sapiens
ccugccugcgcgggcgccc

SEQ ID NO: 1547 - RNA, 19 nt, Homo sapiens
cugccugcgcgggcgcccu

SEQ ID NO: 1548 - RNA, 19 nt, Homo sapiens
ugccugcgcgggcgcccug

SEQ ID NO: 1549 - RNA, 19 nt, Homo sapiens
gccugcgcgggcgcccugc

SEQ ID NO: 1550 - RNA, 19 nt, Homo sapiens
ccugcgcgggcgcccugcc

SEQ ID NO: 1551 - RNA, 19 nt, Homo sapiens
cugcgcgggcgcccugcca

SEQ ID NO: 1552 - RNA, 19 nt, Homo sapiens
ugcgcgggcgcccugccac

SEQ ID NO: 1553 - RNA, 19 nt, Homo sapiens
gcgcgggcgcccugccacc

SEQ ID NO: 1554 - RNA, 19 nt, Homo sapiens
cgcgggcgcccugccaccc

SEQ ID NO: 1555 - RNA, 19 nt, Homo sapiens
gcgggcgcccugccacccu

SEQ ID NO: 1556 - RNA, 19 nt, Homo sapiens
cgggcgcccugccacccug

SEQ ID NO: 1557 - RNA, 19 nt, Homo sapiens
gggcgcccugccacccugu

SEQ ID NO: 1558 - RNA, 19 nt, Homo sapiens
ggcgcccugccacccuguc

SEQ ID NO: 1559 - RNA, 19 nt, Homo sapiens
gcgcccugccacccugucc

SEQ ID NO: 1560 - RNA, 19 nt, Homo sapiens
cgcccugccacccuguccc

SEQ ID NO: 1561 - RNA, 19 nt, Homo sapiens
gcccugccacccugucccg

SEQ ID NO: 1562 - RNA, 19 nt, Homo sapiens
cccugccacccugucccgg

SEQ ID NO: 1563 - RNA, 19 nt, Homo sapiens
ccugccacccugucccggg

SEQ ID NO: 1564 - RNA, 19 nt, Homo sapiens
cugccacccugucccgggu

SEQ ID NO: 1565 - RNA, 19 nt, Homo sapiens
ugccacccugucccgggug

SEQ ID NO: 1566 - RNA, 19 nt, Homo sapiens
gccacccugucccgggugc

SEQ ID NO: 1567 - RNA, 19 nt, Homo sapiens
ccacccugucccgggugcc

SEQ ID NO: 1568 - RNA, 19 nt, Homo sapiens
cacccugucccgggugccu

SEQ ID NO: 1569 - RNA, 19 nt, Homo sapiens
acccugucccgggugccug

SEQ ID NO: 1570 - RNA, 19 nt, Homo sapiens
cccugucccgggugccugg

SEQ ID NO: 1571 - RNA, 19 nt, Homo sapiens
ccugucccgggugccuggc

SEQ ID NO: 1572 - RNA, 19 nt, Homo sapiens
cugucccgggugccuggcc

SEQ ID NO: 1573 - RNA, 19 nt, Homo sapiens
ugucccgggugccuggccc

SEQ ID NO: 1574 - RNA, 19 nt, Homo sapiens
gucccgggugccuggcccu

SEQ ID NO: 1575 - RNA, 19 nt, Homo sapiens
ucccgggugccuggcccuu

SEQ ID NO: 1576 - RNA, 19 nt, Homo sapiens
cccgggugccuggcccuuc

SEQ ID NO: 1577 - RNA, 19 nt, Homo sapiens
ccgggugccuggcccuucg

SEQ ID NO: 1578 - RNA, 19 nt, Homo sapiens
cgggugccuggcccuucga

SEQ ID NO: 1579 - RNA, 19 nt, Homo sapiens
gggugccuggcccuucgau

SEQ ID NO: 1580 - RNA, 19 nt, Homo sapiens
ggugccuggcccuucgauu

SEQ ID NO: 1581 - RNA, 19 nt, Homo sapiens
gugccuggcccuucgauuc

SEQ ID NO: 1582 - RNA, 19 nt, Homo sapiens
ugccuggcccuucgauucu

SEQ ID NO: 1583 - RNA, 19 nt, Homo sapiens
gccuggcccuucgauucug

SEQ ID NO: 1584 - RNA, 19 nt, Homo sapiens
ccuggcccuucgauucuga

SEQ ID NO: 1585 - RNA, 19 nt, Homo sapiens
cuggcccuucgauucugaa

SEQ ID NO: 1586 - RNA, 19 nt, Homo sapiens
uggcccuucgauucugaaa

SEQ ID NO: 1587 - RNA, 19 nt, Homo sapiens
ggcccuucgauucugaaac

SEQ ID NO: 1588 - RNA, 19 nt, Homo sapiens
gcccuucgauucugaaacc

SEQ ID NO: 1589 - RNA, 19 nt, Homo sapiens
cccuucgauucugaaacca

SEQ ID NO: 1590 - RNA, 19 nt, Homo sapiens
ccuucgauucugaaaccag

SEQ ID NO: 1591 - RNA, 19 nt, Homo sapiens
cuucgauucugaaaccaga

SEQ ID NO: 1592 - RNA, 19 nt, Homo sapiens
uucgauucugaaaccagau

SEQ ID NO: 1593 - RNA, 19 nt, Homo sapiens
ucgauucugaaaccagauc

SEQ ID NO: 1594 - RNA, 19 nt, Homo sapiens
cgauucugaaaccagaucu

SEQ ID NO: 1595 - RNA, 19 nt, Homo sapiens
gauucugaaaccagaucug

SEQ ID NO: 1596 - RNA, 19 nt, Homo sapiens
auucugaaaccagaucuga

SEQ ID NO: 1597 - RNA, 19 nt, Homo sapiens
uucugaaaccagaucugaa

SEQ ID NO: 1598 - RNA, 19 nt, Homo sapiens
ucugaaaccagaucugaau

SEQ ID NO: 1599 - RNA, 19 nt, Homo sapiens
cugaaaccagaucugaauc

SEQ ID NO: 1600 - RNA, 19 nt, Homo sapiens
ugaaaccagaucugaaucc

SEQ ID NO: 1601 - RNA, 19 nt, Homo sapiens
gaaaccagaucugaauccu

SEQ ID NO: 1602 - RNA, 19 nt, Homo sapiens
aaaccagaucugaauccug

SEQ ID NO: 1603 - RNA, 19 nt, Homo sapiens
aaccagaucugaauccugg

SEQ ID NO: 1604 - RNA, 19 nt, Homo sapiens
accagaucugaauccugga

SEQ ID NO: 1605 - RNA, 19 nt, Homo sapiens
ccagaucugaauccuggac

SEQ ID NO: 1606 - RNA, 19 nt, Homo sapiens
cagaucugaauccuggacu

SEQ ID NO: 1607 - RNA, 19 nt, Homo sapiens
agaucugaauccuggacuc

SEQ ID NO: 1608 - RNA, 19 nt, Homo sapiens
gaucugaauccuggacucc

SEQ ID NO: 1609 - RNA, 19 nt, Homo sapiens
aucugaauccuggacuccg

SEQ ID NO: 1610 - RNA, 19 nt, Homo sapiens
ucugaauccuggacuccgg

SEQ ID NO: 1611 - RNA, 19 nt, Homo sapiens
cugaauccuggacuccggg

SEQ ID NO: 1612 - RNA, 19 nt, Homo sapiens
ugaauccuggacuccggga

SEQ ID NO: 1613 - RNA, 19 nt, Homo sapiens
gaauccuggacuccgggag

SEQ ID NO: 1614 - RNA, 19 nt, Homo sapiens
aauccuggacuccgggagg

SEQ ID NO: 1615 - RNA, 19 nt, Homo sapiens
auccuggacuccgggaggc

SEQ ID NO: 1616 - RNA, 19 nt, Homo sapiens
uccuggacuccgggaggcc

SEQ ID NO: 1617 - RNA, 19 nt, Homo sapiens
ccuggacuccgggaggccc

SEQ ID NO: 1618 - RNA, 19 nt, Homo sapiens
cuggacuccgggaggcccg

SEQ ID NO: 1619 - RNA, 19 nt, Homo sapiens
uggacuccgggaggcccgu

SEQ ID NO: 1620 - RNA, 19 nt, Homo sapiens
ggacuccgggaggcccguc

SEQ ID NO: 1621 - RNA, 19 nt, Homo sapiens
gacuccgggaggcccgucu

SEQ ID NO: 1622 - RNA, 19 nt, Homo sapiens
acuccgggaggcccgucuc

SEQ ID NO: 1623 - RNA, 19 nt, Homo sapiens
cuccgggaggcccgucucu

SEQ ID NO: 1624 - RNA, 19 nt, Homo sapiens
uccgggaggcccgucucuc

SEQ ID NO: 1625 - RNA, 19 nt, Homo sapiens
ccgggaggcccgucucucu

SEQ ID NO: 1626 - RNA, 19 nt, Homo sapiens
cgggaggcccgucucucug

SEQ ID NO: 1627 - RNA, 19 nt, Homo sapiens
gggaggcccgucucucugg

SEQ ID NO: 1628 - RNA, 19 nt, Homo sapiens
ggaggcccgucucucuggc

SEQ ID NO: 1629 - RNA, 19 nt, Homo sapiens
gaggcccgucucucuggcc

SEQ ID NO: 1630 - RNA, 19 nt, Homo sapiens
aggcccgucucucuggcca

SEQ ID NO: 1631 - RNA, 19 nt, Homo sapiens
ggcccgucucucuggccag

SEQ ID NO: 1632 - RNA, 19 nt, Homo sapiens
gcccgucucucuggccagc

SEQ ID NO: 1633 - RNA, 19 nt, Homo sapiens
cccgucucucuggccagcu

SEQ ID NO: 1634 - RNA, 19 nt, Homo sapiens
ccgucucucuggccagcuc

SEQ ID NO: 1635 - RNA, 19 nt, Homo sapiens
cgucucucuggccagcucc

SEQ ID NO: 1636 - RNA, 19 nt, Homo sapiens
gucucucuggccagcuccu

SEQ ID NO: 1637 - RNA, 19 nt, Homo sapiens
ucucucuggccagcuccuc

SEQ ID NO: 1638 - RNA, 19 nt, Homo sapiens
cucucuggccagcuccucc

SEQ ID NO: 1639 - RNA, 19 nt, Homo sapiens
ucucuggccagcuccuccc

SEQ ID NO: 1640 - RNA, 19 nt, Homo sapiens
cucuggccagcuccucccg

SEQ ID NO: 1641 - RNA, 19 nt, Homo sapiens
ucuggccagcuccucccgg

SEQ ID NO: 1642 - RNA, 19 nt, Homo sapiens
cuggccagcuccucccggg

SEQ ID NO: 1643 - RNA, 19 nt, Homo sapiens
uggccagcuccucccgggc

SEQ ID NO: 1644 - RNA, 19 nt, Homo sapiens
ggccagcuccucccgggcg

SEQ ID NO: 1645 - RNA, 19 nt, Homo sapiens
gccagcuccucccgggcgg

SEQ ID NO: 1646 - RNA, 19 nt, Homo sapiens
ccagcuccucccgggcggc

SEQ ID NO: 1647 - RNA, 19 nt, Homo sapiens
cagcuccucccgggcggcg

SEQ ID NO: 1648 - RNA, 19 nt, Homo sapiens
agcuccucccgggcggcga

SEQ ID NO: 1649 - RNA, 19 nt, Homo sapiens
gcuccucccgggcggcgau

SEQ ID NO: 1650 - RNA, 19 nt, Homo sapiens
cuccucccgggcggcgaug

SEQ ID NO: 1651 - RNA, 19 nt, Homo sapiens
uccucccgggcggcgaugc

SEQ ID NO: 1652 - RNA, 19 nt, Homo sapiens
ccucccgggcggcgaugcc

SEQ ID NO: 1653 - RNA, 19 nt, Homo sapiens
cucccgggcggcgaugccu

SEQ ID NO: 1654 - RNA, 19 nt, Homo sapiens
ucccgggcggcgaugccug

SEQ ID NO: 1655 - RNA, 19 nt, Homo sapiens
cccgggcggcgaugccugg

SEQ ID NO: 1656 - RNA, 19 nt, Homo sapiens
ccgggcggcgaugccugga

SEQ ID NO: 1657 - RNA, 19 nt, Homo sapiens
cgggcggcgaugccuggaa

SEQ ID NO: 1658 - RNA, 19 nt, Homo sapiens
gggcggcgaugccuggaaa

SEQ ID NO: 1659 - RNA, 19 nt, Homo sapiens
ggcggcgaugccuggaaag

SEQ ID NO: 1660 - RNA, 19 nt, Homo sapiens
gcggcgaugccuggaaagc

SEQ ID NO: 1661 - RNA, 19 nt, Homo sapiens
cggcgaugccuggaaagcg

SEQ ID NO: 1662 - RNA, 19 nt, Homo sapiens
ggcgaugccuggaaagcga

SEQ ID NO: 1663 - RNA, 19 nt, Homo sapiens
gcgaugccuggaaagcgau

SEQ ID NO: 1664 - RNA, 19 nt, Homo sapiens
cgaugccuggaaagcgauc

SEQ ID NO: 1665 - RNA, 19 nt, Homo sapiens
gaugccuggaaagcgaucc

SEQ ID NO: 1666 - RNA, 19 nt, Homo sapiens
augccuggaaagcgauccu

SEQ ID NO: 1667 - RNA, 19 nt, Homo sapiens
ugccuggaaagcgauccuu

SEQ ID NO: 1668 - RNA, 19 nt, Homo sapiens
gccuggaaagcgauccuuc

SEQ ID NO: 1669 - RNA, 19 nt, Homo sapiens
ccuggaaagcgauccuucu

SEQ ID NO: 1670 - RNA, 19 nt, Homo sapiens
cuggaaagcgauccuucuc

SEQ ID NO: 1671 - RNA, 19 nt, Homo sapiens
uggaaagcgauccuucuca

SEQ ID NO: 1672 - RNA, 19 nt, Homo sapiens
ggaaagcgauccuucucaa

SEQ ID NO: 1673 - RNA, 19 nt, Homo sapiens
gaaagcgauccuucucaaa

SEQ ID NO: 1674 - RNA, 19 nt, Homo sapiens
aaagcgauccuucucaaag

SEQ ID NO: 1675 - RNA, 19 nt, Homo sapiens
aagcgauccuucucaaagg

SEQ ID NO: 1676 - RNA, 19 nt, Homo sapiens
agcgauccuucucaaaggc

SEQ ID NO: 1677 - RNA, 19 nt, Homo sapiens
gcgauccuucucaaaggcu

SEQ ID NO: 1678 - RNA, 19 nt, Homo sapiens
cgauccuucucaaaggcuc

SEQ ID NO: 1679 - RNA, 19 nt, Homo sapiens
gauccuucucaaaggcucg

SEQ ID NO: 1680 - RNA, 19 nt, Homo sapiens
auccuucucaaaggcucgg

SEQ ID NO: 1681 - RNA, 19 nt, Homo sapiens
uccuucucaaaggcucgga

SEQ ID NO: 1682 - RNA, 19 nt, Homo sapiens
ccuucucaaaggcucggag

SEQ ID NO: 1683 - RNA, 19 nt, Homo sapiens
cuucucaaaggcucggagg

SEQ ID NO: 1684 - RNA, 19 nt, Homo sapiens
uucucaaaggcucggagga

SEQ ID NO: 1685 - RNA, 19 nt, Homo sapiens
ucucaaaggcucggaggag

SEQ ID NO: 1686 - RNA, 19 nt, Homo sapiens
cucaaaggcucggaggagc

SEQ ID NO: 1687 - RNA, 19 nt, Homo sapiens
ucaaaggcucggaggagca

SEQ ID NO: 1688 - RNA, 19 nt, Homo sapiens
caaaggcucggaggagcag

SEQ ID NO: 1689 - RNA, 19 nt, Homo sapiens
aaaggcucggaggagcagg

SEQ ID NO: 1690 - RNA, 19 nt, Homo sapiens
aaggcucggaggagcaggg

SEQ ID NO: 1691 - RNA, 19 nt, Homo sapiens
aggcucggaggagcagggc

SEQ ID NO: 1692 - RNA, 19 nt, Homo sapiens
ggcucggaggagcagggcg

SEQ ID NO: 1693 - RNA, 19 nt, Homo sapiens
gcucggaggagcagggcgg

SEQ ID NO: 1694 - RNA, 19 nt, Homo sapiens
cucggaggagcagggcggu

SEQ ID NO: 1695 - RNA, 19 nt, Homo sapiens
ucggaggagcagggcgguc

SEQ ID NO: 1696 - RNA, 19 nt, Homo sapiens
cggaggagcagggcggucu

SEQ ID NO: 1697 - RNA, 19 nt, Homo sapiens
ggaggagcagggcggucug

SEQ ID NO: 1698 - RNA, 19 nt, Homo sapiens
gaggagcagggcggucugg

SEQ ID NO: 1699 - RNA, 19 nt, Homo sapiens
aggagcagggcggucuggg

SEQ ID NO: 1700 - RNA, 19 nt, Homo sapiens
ggagcagggcggucuggga

SEQ ID NO: 1701 - RNA, 19 nt, Homo sapiens
gagcagggcggucugggau

SEQ ID NO: 1702 - RNA, 19 nt, Homo sapiens
agcagggcggucugggauc

SEQ ID NO: 1703 - RNA, 19 nt, Homo sapiens
gcagggcggucugggaucc

SEQ ID NO: 1704 - RNA, 19 nt, Homo sapiens
cagggcggucugggauccg

SEQ ID NO: 1705 - RNA, 19 nt, Homo sapiens
agggcggucugggauccgg

SEQ ID NO: 1706 - RNA, 19 nt, Homo sapiens
gggcggucugggauccggu

SEQ ID NO: 1707 - RNA, 19 nt, Homo sapiens
ggcggucugggauccggug

SEQ ID NO: 1708 - RNA, 19 nt, Homo sapiens
gcggucugggauccgguga

SEQ ID NO: 1709 - RNA, 19 nt, Homo sapiens
cggucugggauccggugac

SEQ ID NO: 1710 - RNA, 19 nt, Homo sapiens
ggucugggauccggugacg

SEQ ID NO: 1711 - RNA, 19 nt, Homo sapiens
gucugggauccggugacgg

SEQ ID NO: 1712 - RNA, 19 nt, Homo sapiens
ucugggauccggugacggc

SEQ ID NO: 1713 - RNA, 19 nt, Homo sapiens
cugggauccggugacggcg

SEQ ID NO: 1714 - RNA, 19 nt, Homo sapiens
ugggauccggugacggcgg

SEQ ID NO: 1715 - RNA, 19 nt, Homo sapiens
gggauccggugacggcggu

SEQ ID NO: 1716 - RNA, 19 nt, Homo sapiens
ggauccggugacggcgguc

SEQ ID NO: 1717 - RNA, 19 nt, Homo sapiens
gauccggugacggcggucc

SEQ ID NO: 1718 - RNA, 19 nt, Homo sapiens
auccggugacggcgguccg

SEQ ID NO: 1719 - RNA, 19 nt, Homo sapiens
uccggugacggcgguccgc

SEQ ID NO: 1720 - RNA, 19 nt, Homo sapiens
ccggugacggcgguccgcu

SEQ ID NO: 1721 - RNA, 19 nt, Homo sapiens
cggugacggcgguccgcuu

SEQ ID NO: 1722 - RNA, 19 nt, Homo sapiens
ggugacggcgguccgcuuu

SEQ ID NO: 1723 - RNA, 19 nt, Homo sapiens
gugacggcgguccgcuuuc

SEQ ID NO: 1724 - RNA, 19 nt, Homo sapiens
ugacggcgguccgcuuucg

SEQ ID NO: 1725 - RNA, 19 nt, Homo sapiens
gacggcgguccgcuuucgc

SEQ ID NO: 1726 - RNA, 19 nt, Homo sapiens
acggcgguccgcuuucgcc

SEQ ID NO: 1727 - RNA, 19 nt, Homo sapiens
cggcgguccgcuuucgccg

SEQ ID NO: 1728 - RNA, 19 nt, Homo sapiens
ggcgguccgcuuucgccgg

SEQ ID NO: 1729 - RNA, 19 nt, Homo sapiens
gcgguccgcuuucgccggc

SEQ ID NO: 1730 - RNA, 19 nt, Homo sapiens
cgguccgcuuucgccggcc

SEQ ID NO: 1731 - RNA, 19 nt, Homo sapiens
gguccgcuuucgccggccu

SEQ ID NO: 1732 - RNA, 19 nt, Homo sapiens
guccgcuuucgccggccuu

SEQ ID NO: 1733 - RNA, 19 nt, Homo sapiens
uccgcuuucgccggccuuc

SEQ ID NO: 1734 - RNA, 19 nt, Homo sapiens
ccgcuuucgccggccuucu

SEQ ID NO: 1735 - RNA, 19 nt, Homo sapiens
cgcuuucgccggccuucug

SEQ ID NO: 1736 - RNA, 19 nt, Homo sapiens
gcuuucgccggccuucugg

SEQ ID NO: 1737 - RNA, 19 nt, Homo sapiens
cuuucgccggccuucuggc

SEQ ID NO: 1738 - RNA, 19 nt, Homo sapiens
uuucgccggccuucuggcg

SEQ ID NO: 1739 - RNA, 19 nt, Homo sapiens
uucgccggccuucuggcgg

SEQ ID NO: 1740 - RNA, 19 nt, Homo sapiens
ucgccggccuucuggcggg

SEQ ID NO: 1741 - RNA, 19 nt, Homo sapiens
cgccggccuucuggcgggc

SEQ ID NO: 1742 - RNA, 19 nt, Homo sapiens
gccggccuucuggcgggcc

SEQ ID NO: 1743 - RNA, 19 nt, Homo sapiens
ccggccuucuggcgggccg

SEQ ID NO: 1744 - RNA, 19 nt, Homo sapiens
cggccuucuggcgggccgc

SEQ ID NO: 1745 - RNA, 19 nt, Homo sapiens
ggccuucuggcgggccgcg

SEQ ID NO: 1746 - RNA, 19 nt, Homo sapiens
gccuucuggcgggccgcgu

SEQ ID NO: 1747 - RNA, 19 nt, Homo sapiens
ccuucuggcgggccgcguc

SEQ ID NO: 1748 - RNA, 19 nt, Homo sapiens
cuucuggcgggccgcgucu

SEQ ID NO: 1749 - RNA, 19 nt, Homo sapiens
uucuggcgggccgcgucuc

SEQ ID NO: 1750 - RNA, 19 nt, Homo sapiens
ucuggcgggccgcgucucc

SEQ ID NO: 1751 - RNA, 19 nt, Homo sapiens
cuggcgggccgcgucuccc

SEQ ID NO: 1752 - RNA, 19 nt, Homo sapiens
uggcgggccgcgucucccg

SEQ ID NO: 1753 - RNA, 19 nt, Homo sapiens
ggcgggccgcgucucccgg

SEQ ID NO: 1754 - RNA, 19 nt, Homo sapiens
gcgggccgcgucucccggg

SEQ ID NO: 1755 - RNA, 19 nt, Homo sapiens
cgggccgcgucucccgggc

SEQ ID NO: 1756 - RNA, 19 nt, Homo sapiens
gggccgcgucucccgggcc

SEQ ID NO: 1757 - RNA, 19 nt, Homo sapiens
ggccgcgucucccgggcca

SEQ ID NO: 1758 - RNA, 19 nt, Homo sapiens
gccgcgucucccgggccag

SEQ ID NO: 1759 - RNA, 19 nt, Homo sapiens
ccgcgucucccgggccagg

SEQ ID NO: 1760 - RNA, 19 nt, Homo sapiens
cgcgucucccgggccaggg

SEQ ID NO: 1761 - RNA, 19 nt, Homo sapiens
gcgucucccgggccagggc

SEQ ID NO: 1762 - RNA, 19 nt, Homo sapiens
cgucucccgggccagggcc

SEQ ID NO: 1763 - RNA, 19 nt, Homo sapiens
gucucccgggccagggccg

SEQ ID NO: 1764 - RNA, 19 nt, Homo sapiens
ucucccgggccagggccga

SEQ ID NO: 1765 - RNA, 19 nt, Homo sapiens
cucccgggccagggccgag

SEQ ID NO: 1766 - RNA, 19 nt, Homo sapiens
ucccgggccagggccgaga

SEQ ID NO: 1767 - RNA, 19 nt, Homo sapiens
cccgggccagggccgagau

SEQ ID NO: 1768 - RNA, 19 nt, Homo sapiens
ccgggccagggccgagauu

SEQ ID NO: 1769 - RNA, 19 nt, Homo sapiens
cgggccagggccgagauuc

SEQ ID NO: 1770 - RNA, 19 nt, Homo sapiens
gggccagggccgagauucc

SEQ ID NO: 1771 - RNA, 19 nt, Homo sapiens
ggccagggccgagauuccc

SEQ ID NO: 1772 - RNA, 19 nt, Homo sapiens
gccagggccgagauucccg

SEQ ID NO: 1773 - RNA, 19 nt, Homo sapiens
ccagggccgagauucccgc

SEQ ID NO: 1774 - RNA, 19 nt, Homo sapiens
cagggccgagauucccgcc

SEQ ID NO: 1775 - RNA, 19 nt, Homo sapiens
agggccgagauucccgccg

SEQ ID NO: 1776 - RNA, 19 nt, Homo sapiens
gggccgagauucccgccgg

SEQ ID NO: 1777 - RNA, 19 nt, Homo sapiens
ggccgagauucccgccggu

SEQ ID NO: 1778 - RNA, 19 nt, Homo sapiens
gccgagauucccgccggug

SEQ ID NO: 1779 - RNA, 19 nt, Homo sapiens
ccgagauucccgccggugc

SEQ ID NO: 1780 - RNA, 19 nt, Homo sapiens
cgagauucccgccggugcu

SEQ ID NO: 1781 - RNA, 19 nt, Homo sapiens
gagauucccgccggugcug

SEQ ID NO: 1782 - RNA, 19 nt, Homo sapiens
agauucccgccggugcugc

SEQ ID NO: 1783 - RNA, 19 nt, Homo sapiens
gauucccgccggugcugcc

SEQ ID NO: 1784 - RNA, 19 nt, Homo sapiens
auucccgccggugcugccu

SEQ ID NO: 1785 - RNA, 19 nt, Homo sapiens
uucccgccggugcugccuc

SEQ ID NO: 1786 - RNA, 19 nt, Homo sapiens
ucccgccggugcugccuca

SEQ ID NO: 1787 - RNA, 19 nt, Homo sapiens
cccgccggugcugccucag

SEQ ID NO: 1788 - RNA, 19 nt, Homo sapiens
ccgccggugcugccucagc

SEQ ID NO: 1789 - RNA, 19 nt, Homo sapiens
cgccggugcugccucagcu

SEQ ID NO: 1790 - RNA, 19 nt, Homo sapiens
gccggugcugccucagcug

SEQ ID NO: 1791 - RNA, 19 nt, Homo sapiens
ccggugcugccucagcugg

SEQ ID NO: 1792 - RNA, 19 nt, Homo sapiens
cggugcugccucagcuggc

SEQ ID NO: 1793 - RNA, 19 nt, Homo sapiens
ggugcugccucagcuggcg

SEQ ID NO: 1794 - RNA, 19 nt, Homo sapiens
gugcugccucagcuggcgu

SEQ ID NO: 1795 - RNA, 19 nt, Homo sapiens
ugcugccucagcuggcgug

SEQ ID NO: 1796 - RNA, 19 nt, Homo sapiens
gcugccucagcuggcguga

SEQ ID NO: 1797 - RNA, 19 nt, Homo sapiens
cugccucagcuggcgugac

SEQ ID NO: 1798 - RNA, 19 nt, Homo sapiens
ugccucagcuggcgugacc

SEQ ID NO: 1799 - RNA, 19 nt, Homo sapiens
gccucagcuggcgugaccu

SEQ ID NO: 1800 - RNA, 19 nt, Homo sapiens
ccucagcuggcgugaccuc

SEQ ID NO: 1801 - RNA, 19 nt, Homo sapiens
cucagcuggcgugaccucu

SEQ ID NO: 1802 - RNA, 19 nt, Homo sapiens
ucagcuggcgugaccucuc

SEQ ID NO: 1803 - RNA, 19 nt, Homo sapiens
cagcuggcgugaccucuca

SEQ ID NO: 1804 - RNA, 19 nt, Homo sapiens
agcuggcgugaccucucau

SEQ ID NO: 1805 - RNA, 19 nt, Homo sapiens
gcuggcgugaccucucauu

SEQ ID NO: 1806 - RNA, 19 nt, Homo sapiens
cuggcgugaccucucauuc

SEQ ID NO: 1807 - RNA, 19 nt, Homo sapiens
uggcgugaccucucauucu

SEQ ID NO: 1808 - RNA, 19 nt, Homo sapiens
ggcgugaccucucauucug

SEQ ID NO: 1809 - RNA, 19 nt, Homo sapiens
gcgugaccucucauucuga

SEQ ID NO: 1810 - RNA, 19 nt, Homo sapiens
cgugaccucucauucugaa

SEQ ID NO: 1811 - RNA, 19 nt, Homo sapiens
gugaccucucauucugaaa

SEQ ID NO: 1812 - RNA, 19 nt, Homo sapiens
ugaccucucauucugaaac

SEQ ID NO: 1813 - RNA, 19 nt, Homo sapiens
gaccucucauucugaaacc

SEQ ID NO: 1814 - RNA, 19 nt, Homo sapiens
accucucauucugaaacca

SEQ ID NO: 1815 - RNA, 19 nt, Homo sapiens
ccucucauucugaaaccaa

SEQ ID NO: 1816 - RNA, 19 nt, Homo sapiens
cucucauucugaaaccaaa

SEQ ID NO: 1817 - RNA, 19 nt, Homo sapiens
ucucauucugaaaccaaau

SEQ ID NO: 1818 - RNA, 19 nt, Homo sapiens
cucauucugaaaccaaauc

SEQ ID NO: 1819 - RNA, 19 nt, Homo sapiens
ucauucugaaaccaaaucu

SEQ ID NO: 1820 - RNA, 19 nt, Homo sapiens
cauucugaaaccaaaucug

SEQ ID NO: 1821 - RNA, 19 nt, Homo sapiens
auucugaaaccaaaucugg

SEQ ID NO: 1822 - RNA, 19 nt, Homo sapiens
uucugaaaccaaaucugga

SEQ ID NO: 1823 - RNA, 19 nt, Homo sapiens
ucugaaaccaaaucuggac

SEQ ID NO: 1824 - RNA, 19 nt, Homo sapiens
cugaaaccaaaucuggacc

SEQ ID NO: 1825 - RNA, 19 nt, Homo sapiens
ugaaaccaaaucuggaccc

SEQ ID NO: 1826 - RNA, 19 nt, Homo sapiens
gaaaccaaaucuggacccu

SEQ ID NO: 1827 - RNA, 19 nt, Homo sapiens
aaaccaaaucuggacccug

SEQ ID NO: 1828 - RNA, 19 nt, Homo sapiens
aaccaaaucuggacccugg

SEQ ID NO: 1829 - RNA, 19 nt, Homo sapiens
accaaaucuggacccuggg

SEQ ID NO: 1830 - RNA, 19 nt, Homo sapiens
ccaaaucuggacccugggc

SEQ ID NO: 1831 - RNA, 19 nt, Homo sapiens
caaaucuggacccugggcu

SEQ ID NO: 1832 - RNA, 19 nt, Homo sapiens
aaaucuggacccugggcuc

SEQ ID NO: 1833 - RNA, 19 nt, Homo sapiens
aaucuggacccugggcucc

SEQ ID NO: 1834 - RNA, 19 nt, Homo sapiens
aucuggacccugggcuccg

SEQ ID NO: 1835 - RNA, 19 nt, Homo sapiens
ucuggacccugggcuccgg

SEQ ID NO: 1836 - RNA, 19 nt, Homo sapiens
cuggacccugggcuccgga

SEQ ID NO: 1837 - RNA, 19 nt, Homo sapiens
uggacccugggcuccggaa

SEQ ID NO: 1838 - RNA, 19 nt, Homo sapiens
ggacccugggcuccggaau

SEQ ID NO: 1839 - RNA, 19 nt, Homo sapiens
gacccugggcuccggaaug

SEQ ID NO: 1840 - RNA, 19 nt, Homo sapiens
acccugggcuccggaaugc

SEQ ID NO: 1841 - RNA, 19 nt, Homo sapiens
cccugggcuccggaaugcc

SEQ ID NO: 1842 - RNA, 19 nt, Homo sapiens
ccugggcuccggaaugccg

SEQ ID NO: 1843 - RNA, 19 nt, Homo sapiens
cugggcuccggaaugccga

SEQ ID NO: 1844 - RNA, 19 nt, Homo sapiens
ugggcuccggaaugccgau

SEQ ID NO: 1845 - RNA, 19 nt, Homo sapiens
gggcuccggaaugccgaug

SEQ ID NO: 1846 - RNA, 19 nt, Homo sapiens
ggcuccggaaugccgaugg

SEQ ID NO: 1847 - RNA, 19 nt, Homo sapiens
gcuccggaaugccgauggc

SEQ ID NO: 1848 - RNA, 19 nt, Homo sapiens
cuccggaaugccgauggcc

SEQ ID NO: 1849 - RNA, 19 nt, Homo sapiens
uccggaaugccgauggccu

SEQ ID NO: 1850 - RNA, 19 nt, Homo sapiens
ccggaaugccgauggccug

SEQ ID NO: 1851 - RNA, 19 nt, Homo sapiens
cggaaugccgauggccugg

SEQ ID NO: 1852 - RNA, 19 nt, Homo sapiens
ggaaugccgauggccuggg

SEQ ID NO: 1853 - RNA, 19 nt, Homo sapiens
gaaugccgauggccugggc

SEQ ID NO: 1854 - RNA, 19 nt, Homo sapiens
aaugccgauggccugggcc

SEQ ID NO: 1855 - RNA, 19 nt, Homo sapiens
augccgauggccugggcca

SEQ ID NO: 1856 - RNA, 19 nt, Homo sapiens
ugccgauggccugggccag

SEQ ID NO: 1857 - RNA, 19 nt, Homo sapiens
gccgauggccugggccagc

SEQ ID NO: 1858 - RNA, 19 nt, Homo sapiens
ccgauggccugggccagcc

SEQ ID NO: 1859 - RNA, 19 nt, Homo sapiens
cgauggccugggccagccg

SEQ ID NO: 1860 - RNA, 19 nt, Homo sapiens
gauggccugggccagccgu

SEQ ID NO: 1861 - RNA, 19 nt, Homo sapiens
auggccugggccagccguu

SEQ ID NO: 1862 - RNA, 19 nt, Homo sapiens
uggccugggccagccguuc

SEQ ID NO: 1863 - RNA, 19 nt, Homo sapiens
ggccugggccagccguucu

SEQ ID NO: 1864 - RNA, 19 nt, Homo sapiens
gccugggccagccguucuc

SEQ ID NO: 1865 - RNA, 19 nt, Homo sapiens
ccugggccagccguucucu

SEQ ID NO: 1866 - RNA, 19 nt, Homo sapiens
cugggccagccguucucug

SEQ ID NO: 1867 - RNA, 19 nt, Homo sapiens
ugggccagccguucucugg

SEQ ID NO: 1868 - RNA, 19 nt, Homo sapiens
gggccagccguucucuggu

SEQ ID NO: 1869 - RNA, 19 nt, Homo sapiens
ggccagccguucucuggug

SEQ ID NO: 1870 - RNA, 19 nt, Homo sapiens
gccagccguucucuggugg

SEQ ID NO: 1871 - RNA, 19 nt, Homo sapiens
ccagccguucucugguggc

SEQ ID NO: 1872 - RNA, 19 nt, Homo sapiens
cagccguucucugguggcg

SEQ ID NO: 1873 - RNA, 19 nt, Homo sapiens
agccguucucugguggcga

SEQ ID NO: 1874 - RNA, 19 nt, Homo sapiens
gccguucucugguggcgau

SEQ ID NO: 1875 - RNA, 19 nt, Homo sapiens
ccguucucugguggcgaug

SEQ ID NO: 1876 - RNA, 19 nt, Homo sapiens
cguucucugguggcgaugc

SEQ ID NO: 1877 - RNA, 19 nt, Homo sapiens
guucucugguggcgaugcc

SEQ ID NO: 1878 - RNA, 19 nt, Homo sapiens
uucucugguggcgaugccc

SEQ ID NO: 1879 - RNA, 19 nt, Homo sapiens
ucucugguggcgaugcccg

SEQ ID NO: 1880 - RNA, 19 nt, Homo sapiens
cucugguggcgaugcccgg

SEQ ID NO: 1881 - RNA, 19 nt, Homo sapiens
ucugguggcgaugcccggg

SEQ ID NO: 1882 - RNA, 19 nt, Homo sapiens
cugguggcgaugcccgggu

SEQ ID NO: 1883 - RNA, 19 nt, Homo sapiens
ugguggcgaugcccgggua

SEQ ID NO: 1884 - RNA, 19 nt, Homo sapiens
gguggcgaugcccggguac

SEQ ID NO: 1885 - RNA, 19 nt, Homo sapiens
guggcgaugcccggguacg

SEQ ID NO: 1886 - RNA, 19 nt, Homo sapiens
uggcgaugcccggguacgg

SEQ ID NO: 1887 - RNA, 19 nt, Homo sapiens
ggcgaugcccggguacggg

SEQ ID NO: 1888 - RNA, 19 nt, Homo sapiens
gcgaugcccggguacgggu

SEQ ID NO: 1889 - RNA, 19 nt, Homo sapiens
cgaugcccggguacggguu

SEQ ID NO: 1890 - RNA, 19 nt, Homo sapiens
gaugcccggguacggguuc

SEQ ID NO: 1891 - RNA, 19 nt, Homo sapiens
augcccggguacggguucc

SEQ ID NO: 1892 - RNA, 19 nt, Homo sapiens
ugcccggguacggguuccg

SEQ ID NO: 1893 - RNA, 19 nt, Homo sapiens
gcccggguacggguuccgc

SEQ ID NO: 1894 - RNA, 19 nt, Homo sapiens
cccggguacggguuccgcu

SEQ ID NO: 1895 - RNA, 19 nt, Homo sapiens
ccggguacggguuccgcuc

SEQ ID NO: 1896 - RNA, 19 nt, Homo sapiens
cggguacggguuccgcuca

SEQ ID NO: 1897 - RNA, 19 nt, Homo sapiens
ggguacggguuccgcucaa

SEQ ID NO: 1898 - RNA, 19 nt, Homo sapiens
gguacggguuccgcucaaa

SEQ ID NO: 1899 - RNA, 19 nt, Homo sapiens
guacggguuccgcucaaag

SEQ ID NO: 1900 - RNA, 19 nt, Homo sapiens
uacggguuccgcucaaagc

SEQ ID NO: 1901 - RNA, 19 nt, Homo sapiens
acggguuccgcucaaagca

SEQ ID NO: 1902 - RNA, 19 nt, Homo sapiens
cggguuccgcucaaagcag

SEQ ID NO: 1903 - RNA, 19 nt, Homo sapiens
ggguuccgcucaaagcagg

SEQ ID NO: 1904 - RNA, 19 nt, Homo sapiens
gguuccgcucaaagcaggc

SEQ ID NO: 1905 - RNA, 19 nt, Homo sapiens
guuccgcucaaagcaggcu

SEQ ID NO: 1906 - RNA, 19 nt, Homo sapiens
uuccgcucaaagcaggcuc

SEQ ID NO: 1907 - RNA, 19 nt, Homo sapiens
uccgcucaaagcaggcucg

SEQ ID NO: 1908 - RNA, 19 nt, Homo sapiens
ccgcucaaagcaggcucgc

SEQ ID NO: 1909 - RNA, 19 nt, Homo sapiens
cgcucaaagcaggcucgca

SEQ ID NO: 1910 - RNA, 19 nt, Homo sapiens
gcucaaagcaggcucgcag

SEQ ID NO: 1911 - RNA, 19 nt, Homo sapiens
cucaaagcaggcucgcagg

SEQ ID NO: 1912 - RNA, 19 nt, Homo sapiens
ucaaagcaggcucgcaggg

SEQ ID NO: 1913 - RNA, 19 nt, Homo sapiens
caaagcaggcucgcagggc

SEQ ID NO: 1914 - RNA, 19 nt, Homo sapiens
aaagcaggcucgcagggcc

SEQ ID NO: 1915 - RNA, 19 nt, Homo sapiens
aagcaggcucgcagggccu

SEQ ID NO: 1916 - RNA, 19 nt, Homo sapiens
agcaggcucgcagggccuc

SEQ ID NO: 1917 - RNA, 19 nt, Homo sapiens
gcaggcucgcagggccucg

SEQ ID NO: 1918 - RNA, 19 nt, Homo sapiens
caggcucgcagggccucgc

SEQ ID NO: 1919 - RNA, 19 nt, Homo sapiens
aggcucgcagggccucgcu

SEQ ID NO: 1920 - RNA, 19 nt, Homo sapiens
ggcucgcagggccucgcuu

SEQ ID NO: 1921 - RNA, 19 nt, Homo sapiens
gcucgcagggccucgcuuu

SEQ ID NO: 1922 - RNA, 19 nt, Homo sapiens
cucgcagggccucgcuuug

SEQ ID NO: 1923 - RNA, 19 nt, Homo sapiens
ucgcagggccucgcuuugg

SEQ ID NO: 1924 - RNA, 19 nt, Homo sapiens
cgcagggccucgcuuuggc

SEQ ID NO: 1925 - RNA, 19 nt, Homo sapiens
gcagggccucgcuuuggcu

SEQ ID NO: 1926 - RNA, 19 nt, Homo sapiens
cagggccucgcuuuggcuc

SEQ ID NO: 1927 - RNA, 19 nt, Homo sapiens
agggccucgcuuuggcucg

SEQ ID NO: 1928 - RNA, 19 nt, Homo sapiens
gggccucgcuuuggcucgg

SEQ ID NO: 1929 - RNA, 19 nt, Homo sapiens
ggccucgcuuuggcucggg

SEQ ID NO: 1930 - RNA, 19 nt, Homo sapiens
gccucgcuuuggcucgggg

SEQ ID NO: 1931 - RNA, 19 nt, Homo sapiens
ccucgcuuuggcucggggu

SEQ ID NO: 1932 - RNA, 19 nt, Homo sapiens
cucgcuuuggcucgggguc

SEQ ID NO: 1933 - RNA, 19 nt, Homo sapiens
ucgcuuuggcucggggucc

SEQ ID NO: 1934 - RNA, 19 nt, Homo sapiens
cgcuuuggcucggggucca

SEQ ID NO: 1935 - RNA, 19 nt, Homo sapiens
gcuuuggcucgggguccaa

SEQ ID NO: 1936 - RNA, 19 nt, Homo sapiens
cuuuggcucgggguccaaa

SEQ ID NO: 1937 - RNA, 19 nt, Homo sapiens
uuuggcucgggguccaaac

SEQ ID NO: 1938 - RNA, 19 nt, Homo sapiens
uuggcucgggguccaaacg

SEQ ID NO: 1939 - RNA, 19 nt, Homo sapiens
uggcucgggguccaaacga

SEQ ID NO: 1940 - RNA, 19 nt, Homo sapiens
ggcucgggguccaaacgag

SEQ ID NO: 1941 - RNA, 19 nt, Homo sapiens
gcucgggguccaaacgagu

SEQ ID NO: 1942 - RNA, 19 nt, Homo sapiens
cucgggguccaaacgaguc

SEQ ID NO: 1943 - RNA, 19 nt, Homo sapiens
ucgggguccaaacgagucu

SEQ ID NO: 1944 - RNA, 19 nt, Homo sapiens
cgggguccaaacgagucuc

SEQ ID NO: 1945 - RNA, 19 nt, Homo sapiens
gggguccaaacgagucucc

SEQ ID NO: 1946 - RNA, 19 nt, Homo sapiens
ggguccaaacgagucuccg

SEQ ID NO: 1947 - RNA, 19 nt, Homo sapiens
gguccaaacgagucuccgu

SEQ ID NO: 1948 - RNA, 19 nt, Homo sapiens
guccaaacgagucuccguc

SEQ ID NO: 1949 - RNA, 19 nt, Homo sapiens
uccaaacgagucuccgucg

SEQ ID NO: 1950 - RNA, 19 nt, Homo sapiens
ccaaacgagucuccgucgc

SEQ ID NO: 1951 - RNA, 19 nt, Homo sapiens
caaacgagucuccgucgcc

SEQ ID NO: 1952 - RNA, 19 nt, Homo sapiens
aaacgagucuccgucgccg

SEQ ID NO: 1953 - RNA, 19 nt, Homo sapiens
aacgagucuccgucgccgu

SEQ ID NO: 1954 - RNA, 19 nt, Homo sapiens
acgagucuccgucgccguc

SEQ ID NO: 1955 - RNA, 19 nt, Homo sapiens
cgagucuccgucgccgucc

SEQ ID NO: 1956 - RNA, 19 nt, Homo sapiens
gagucuccgucgccguccu

SEQ ID NO: 1957 - RNA, 19 nt, Homo sapiens
agucuccgucgccguccuc

SEQ ID NO: 1958 - RNA, 19 nt, Homo sapiens
gucuccgucgccguccucg

SEQ ID NO: 1959 - RNA, 19 nt, Homo sapiens
ucuccgucgccguccucgu

SEQ ID NO: 1960 - RNA, 19 nt, Homo sapiens
cuccgucgccguccucguc

SEQ ID NO: 1961 - RNA, 19 nt, Homo sapiens
uccgucgccguccucgucc

SEQ ID NO: 1962 - RNA, 19 nt, Homo sapiens
ccgucgccguccucguccc

SEQ ID NO: 1963 - RNA, 19 nt, Homo sapiens
cgucgccguccucgucccc

SEQ ID NO: 1964 - RNA, 19 nt, Homo sapiens
gucgccguccucguccccg

SEQ ID NO: 1965 - RNA, 19 nt, Homo sapiens
ucgccguccucguccccgg

SEQ ID NO: 1966 - RNA, 19 nt, Homo sapiens
cgccguccucguccccggg

SEQ ID NO: 1967 - RNA, 19 nt, Homo sapiens
gccguccucguccccgggc

SEQ ID NO: 1968 - RNA, 19 nt, Homo sapiens
ccguccucguccccgggcu

SEQ ID NO: 1969 - RNA, 19 nt, Homo sapiens
cguccucguccccgggcuu

SEQ ID NO: 1970 - RNA, 19 nt, Homo sapiens
guccucguccccgggcuuc

SEQ ID NO: 1971 - RNA, 19 nt, Homo sapiens
uccucguccccgggcuucc

SEQ ID NO: 1972 - RNA, 19 nt, Homo sapiens
ccucguccccgggcuuccg

SEQ ID NO: 1973 - RNA, 19 nt, Homo sapiens
cucguccccgggcuuccgc

SEQ ID NO: 1974 - RNA, 19 nt, Homo sapiens
ucguccccgggcuuccgcg

SEQ ID NO: 1975 - RNA, 19 nt, Homo sapiens
cguccccgggcuuccgcgg

SEQ ID NO: 1976 - RNA, 19 nt, Homo sapiens
guccccgggcuuccgcggg

SEQ ID NO: 1977 - RNA, 19 nt, Homo sapiens
uccccgggcuuccgcgggg

SEQ ID NO: 1978 - RNA, 19 nt, Homo sapiens
ccccgggcuuccgcgggga

SEQ ID NO: 1979 - RNA, 19 nt, Homo sapiens
cccgggcuuccgcggggag

SEQ ID NO: 1980 - RNA, 19 nt, Homo sapiens
ccgggcuuccgcggggagg

SEQ ID NO: 1981 - RNA, 19 nt, Homo sapiens
cgggcuuccgcggggaggg

SEQ ID NO: 1982 - RNA, 19 nt, Homo sapiens
gggcuuccgcggggagggu

SEQ ID NO: 1983 - RNA, 19 nt, Homo sapiens
ggcuuccgcggggagggug

SEQ ID NO: 1984 - RNA, 19 nt, Homo sapiens
gcuuccgcggggagggugc

SEQ ID NO: 1985 - RNA, 19 nt, Homo sapiens
cuuccgcggggagggugcu

SEQ ID NO: 1986 - RNA, 19 nt, Homo sapiens
uuccgcggggagggugcug

SEQ ID NO: 1987 - RNA, 19 nt, Homo sapiens
uccgcggggagggugcugu

SEQ ID NO: 1988 - RNA, 19 nt, Homo sapiens
ccgcggggagggugcuguc

SEQ ID NO: 1989 - RNA, 19 nt, Homo sapiens
cgcggggagggugcugucc

SEQ ID NO: 1990 - RNA, 19 nt, Homo sapiens
gcggggagggugcuguccg

SEQ ID NO: 1991 - RNA, 19 nt, Homo sapiens
cggggagggugcuguccga

SEQ ID NO: 1992 - RNA, 19 nt, Homo sapiens
ggggagggugcuguccgag

SEQ ID NO: 1993 - RNA, 19 nt, Homo sapiens
gggagggugcuguccgagg

SEQ ID NO: 1994 - RNA, 19 nt, Homo sapiens
ggagggugcuguccgaggg

SEQ ID NO: 1995 - RNA, 19 nt, Homo sapiens
gagggugcuguccgagggu

SEQ ID NO: 1996 - RNA, 19 nt, Homo sapiens
agggugcuguccgagggug

SEQ ID NO: 1997 - RNA, 19 nt, Homo sapiens
gggugcuguccgagggugu

SEQ ID NO: 1998 - RNA, 19 nt, Homo sapiens
ggugcuguccgaggguguc

SEQ ID NO: 1999 - RNA, 19 nt, Homo sapiens
gugcuguccgagggugucg

SEQ ID NO: 2000 - RNA, 19 nt, Homo sapiens
ugcuguccgagggugucgg

SEQ ID NO: 2001 - RNA, 19 nt, Homo sapiens
gcuguccgagggugucggg

SEQ ID NO: 2002 - RNA, 19 nt, Homo sapiens
cuguccgagggugucggga

SEQ ID NO: 2003 - RNA, 19 nt, Homo sapiens
uguccgagggugucgggag

SEQ ID NO: 2004 - RNA, 19 nt, Homo sapiens
guccgagggugucgggagg

SEQ ID NO: 2005 - RNA, 19 nt, Homo sapiens
uccgagggugucgggaggg

SEQ ID NO: 2006 - RNA, 19 nt, Homo sapiens
ccgagggugucgggagggc

SEQ ID NO: 2007 - RNA, 19 nt, Homo sapiens
cgagggugucgggagggcc

SEQ ID NO: 2008 - RNA, 19 nt, Homo sapiens
gagggugucgggagggcca

SEQ ID NO: 2009 - RNA, 19 nt, Homo sapiens
agggugucgggagggccau

SEQ ID NO: 2010 - RNA, 19 nt, Homo sapiens
gggugucgggagggccauc

SEQ ID NO: 2011 - RNA, 19 nt, Homo sapiens
ggugucgggagggccaucg

SEQ ID NO: 2012 - RNA, 19 nt, Homo sapiens
gugucgggagggccaucgc

SEQ ID NO: 2013 - RNA, 19 nt, Homo sapiens
ugucgggagggccaucgcg

SEQ ID NO: 2014 - RNA, 19 nt, Homo sapiens
gucgggagggccaucgcgg

SEQ ID NO: 2015 - RNA, 19 nt, Homo sapiens
ucgggagggccaucgcggu

SEQ ID NO: 2016 - RNA, 19 nt, Homo sapiens
cgggagggccaucgcggug

SEQ ID NO: 2017 - RNA, 19 nt, Homo sapiens
gggagggccaucgcgguga

SEQ ID NO: 2018 - RNA, 19 nt, Homo sapiens
ggagggccaucgcggugag

SEQ ID NO: 2019 - RNA, 19 nt, Homo sapiens
gagggccaucgcggugagc

SEQ ID NO: 2020 - RNA, 19 nt, Homo sapiens
agggccaucgcggugagcc

SEQ ID NO: 2021 - RNA, 19 nt, Homo sapiens
gggccaucgcggugagccc

SEQ ID NO: 2022 - RNA, 19 nt, Homo sapiens
ggccaucgcggugagcccc

SEQ ID NO: 2023 - RNA, 19 nt, Homo sapiens
gccaucgcggugagccccg

SEQ ID NO: 2024 - RNA, 19 nt, Homo sapiens
ccaucgcggugagccccgg

SEQ ID NO: 2025 - RNA, 19 nt, Homo sapiens
caucgcggugagccccggc

SEQ ID NO: 2026 - RNA, 19 nt, Homo sapiens
aucgcggugagccccggcc

SEQ ID NO: 2027 - RNA, 19 nt, Homo sapiens
ucgcggugagccccggccg

SEQ ID NO: 2028 - RNA, 19 nt, Homo sapiens
cgcggugagccccggccgg

SEQ ID NO: 2029 - RNA, 19 nt, Homo sapiens
gcggugagccccggccgga

SEQ ID NO: 2030 - RNA, 19 nt, Homo sapiens
cggugagccccggccggaa

SEQ ID NO: 2031 - RNA, 19 nt, Homo sapiens
ggugagccccggccggaau

SEQ ID NO: 2032 - RNA, 19 nt, Homo sapiens
gugagccccggccggaauu

SEQ ID NO: 2033 - RNA, 19 nt, Homo sapiens
ugagccccggccggaauuu

SEQ ID NO: 2034 - RNA, 19 nt, Homo sapiens
gagccccggccggaauuuc

SEQ ID NO: 2035 - RNA, 19 nt, Homo sapiens
agccccggccggaauuuca

SEQ ID NO: 2036 - RNA, 19 nt, Homo sapiens
gccccggccggaauuucac

SEQ ID NO: 2037 - RNA, 19 nt, Homo sapiens
ccccggccggaauuucacg

SEQ ID NO: 2038 - RNA, 19 nt, Homo sapiens
cccggccggaauuucacgg

SEQ ID NO: 2039 - RNA, 19 nt, Homo sapiens
ccggccggaauuucacgga

SEQ ID NO: 2040 - RNA, 19 nt, Homo sapiens
cggccggaauuucacggac

SEQ ID NO: 2041 - RNA, 19 nt, Homo sapiens
ggccggaauuucacggacg

SEQ ID NO: 2042 - RNA, 19 nt, Homo sapiens
gccggaauuucacggacgg

SEQ ID NO: 2043 - RNA, 19 nt, Homo sapiens
ccggaauuucacggacgga

SEQ ID NO: 2044 - RNA, 19 nt, Homo sapiens
cggaauuucacggacggac

SEQ ID NO: 2045 - RNA, 19 nt, Homo sapiens
ggaauuucacggacggacg

SEQ ID NO: 2046 - RNA, 19 nt, Homo sapiens
gaauuucacggacggacgc

SEQ ID NO: 2047 - RNA, 19 nt, Homo sapiens
aauuucacggacggacgcg

SEQ ID NO: 2048 - RNA, 19 nt, Homo sapiens
auuucacggacggacgcgg

SEQ ID NO: 2049 - RNA, 19 nt, Homo sapiens
uuucacggacggacgcggg

SEQ ID NO: 2050 - RNA, 19 nt, Homo sapiens
uucacggacggacgcgggc

SEQ ID NO: 2051 - RNA, 19 nt, Homo sapiens
ucacggacggacgcgggca

SEQ ID NO: 2052 - RNA, 19 nt, Homo sapiens
cacggacggacgcgggcag

SEQ ID NO: 2053 - RNA, 19 nt, Homo sapiens
acggacggacgcgggcaga

SEQ ID NO: 2054 - RNA, 19 nt, Homo sapiens
cggacggacgcgggcagag

SEQ ID NO: 2055 - RNA, 19 nt, Homo sapiens
ggacggacgcgggcagaga

SEQ ID NO: 2056 - RNA, 19 nt, Homo sapiens
gacggacgcgggcagagag

SEQ ID NO: 2057 - RNA, 19 nt, Homo sapiens
acggacgcgggcagagaga

SEQ ID NO: 2058 - RNA, 19 nt, Homo sapiens
cggacgcgggcagagagag

SEQ ID NO: 2059 - RNA, 19 nt, Homo sapiens
ggacgcgggcagagagagg

SEQ ID NO: 2060 - RNA, 19 nt, Homo sapiens
gacgcgggcagagagaggc

SEQ ID NO: 2061 - RNA, 19 nt, Homo sapiens
acgcgggcagagagaggcc

SEQ ID NO: 2062 - RNA, 19 nt, Homo sapiens
cgcgggcagagagaggccg

SEQ ID NO: 2063 - RNA, 19 nt, Homo sapiens
gcgggcagagagaggccgg

SEQ ID NO: 2064 - RNA, 19 nt, Homo sapiens
cgggcagagagaggccggc

SEQ ID NO: 2065 - RNA, 19 nt, Homo sapiens
gggcagagagaggccggcg

SEQ ID NO: 2066 - RNA, 19 nt, Homo sapiens
ggcagagagaggccggcgg

SEQ ID NO: 2067 - RNA, 19 nt, Homo sapiens
gcagagagaggccggcggg

SEQ ID NO: 2068 - RNA, 19 nt, Homo sapiens
cagagagaggccggcgggc

SEQ ID NO: 2069 - RNA, 19 nt, Homo sapiens
agagagaggccggcgggcu

SEQ ID NO: 2070 - RNA, 19 nt, Homo sapiens
gagagaggccggcgggcuc

SEQ ID NO: 2071 - RNA, 19 nt, Homo sapiens
agagaggccggcgggcucc

SEQ ID NO: 2072 - RNA, 19 nt, Homo sapiens
gagaggccggcgggcuccc

SEQ ID NO: 2073 - RNA, 19 nt, Homo sapiens
agaggccggcgggcucccg

SEQ ID NO: 2074 - RNA, 19 nt, Homo sapiens
gaggccggcgggcucccgu

SEQ ID NO: 2075 - RNA, 19 nt, Homo sapiens
aggccggcgggcucccgug

SEQ ID NO: 2076 - RNA, 19 nt, Homo sapiens
ggccggcgggcucccgugc

SEQ ID NO: 2077 - RNA, 19 nt, Homo sapiens
gccggcgggcucccgugca

SEQ ID NO: 2078 - RNA, 19 nt, Homo sapiens
ccggcgggcucccgugcac

SEQ ID NO: 2079 - RNA, 19 nt, Homo sapiens
cggcgggcucccgugcacc

SEQ ID NO: 2080 - RNA, 19 nt, Homo sapiens
ggcgggcucccgugcaccu

SEQ ID NO: 2081 - RNA, 19 nt, Homo sapiens
gcgggcucccgugcaccuc

SEQ ID NO: 2082 - RNA, 19 nt, Homo sapiens
cgggcucccgugcaccuca

SEQ ID NO: 2083 - RNA, 19 nt, Homo sapiens
gggcucccgugcaccucag

SEQ ID NO: 2084 - RNA, 19 nt, Homo sapiens
ggcucccgugcaccucagc

SEQ ID NO: 2085 - RNA, 19 nt, Homo sapiens
gcucccgugcaccucagcc

SEQ ID NO: 2086 - RNA, 19 nt, Homo sapiens
cucccgugcaccucagccg

SEQ ID NO: 2087 - RNA, 19 nt, Homo sapiens
ucccgugcaccucagccgg

SEQ ID NO: 2088 - RNA, 19 nt, Homo sapiens
cccgugcaccucagccgga

SEQ ID NO: 2089 - RNA, 19 nt, Homo sapiens
ccgugcaccucagccggac

SEQ ID NO: 2090 - RNA, 19 nt, Homo sapiens
cgugcaccucagccggacu

SEQ ID NO: 2091 - RNA, 19 nt, Homo sapiens
gugcaccucagccggacug

SEQ ID NO: 2092 - RNA, 19 nt, Homo sapiens
ugcaccucagccggacugu

SEQ ID NO: 2093 - RNA, 19 nt, Homo sapiens
gcaccucagccggacugug

SEQ ID NO: 2094 - RNA, 19 nt, Homo sapiens
caccucagccggacugugc

SEQ ID NO: 2095 - RNA, 19 nt, Homo sapiens
accucagccggacugugca

SEQ ID NO: 2096 - RNA, 19 nt, Homo sapiens
ccucagccggacugugcac

SEQ ID NO: 2097 - RNA, 19 nt, Homo sapiens
cucagccggacugugcacu

SEQ ID NO: 2098 - RNA, 19 nt, Homo sapiens
ucagccggacugugcacug

SEQ ID NO: 2099 - RNA, 19 nt, Homo sapiens
cagccggacugugcacugc

SEQ ID NO: 2100 - RNA, 19 nt, Homo sapiens
agccggacugugcacugcg

SEQ ID NO: 2101 - RNA, 19 nt, Homo sapiens
gccggacugugcacugcgg

SEQ ID NO: 2102 - RNA, 19 nt, Homo sapiens
ccggacugugcacugcggc

SEQ ID NO: 2103 - RNA, 19 nt, Homo sapiens
cggacugugcacugcggca

SEQ ID NO: 2104 - RNA, 19 nt, Homo sapiens
ggacugugcacugcggcag

SEQ ID NO: 2105 - RNA, 19 nt, Homo sapiens
gacugugcacugcggcagg

SEQ ID NO: 2106 - RNA, 19 nt, Homo sapiens
acugugcacugcggcaggu

SEQ ID NO: 2107 - RNA, 19 nt, Homo sapiens
cugugcacugcggcaggug

SEQ ID NO: 2108 - RNA, 19 nt, Homo sapiens
ugugcacugcggcaggugc

SEQ ID NO: 2109 - RNA, 19 nt, Homo sapiens
gugcacugcggcaggugca

SEQ ID NO: 2110 - RNA, 19 nt, Homo sapiens
ugcacugcggcaggugcag

SEQ ID NO: 2111 - RNA, 19 nt, Homo sapiens
gcacugcggcaggugcagc

SEQ ID NO: 2112 - RNA, 19 nt, Homo sapiens
cacugcggcaggugcagcc

SEQ ID NO: 2113 - RNA, 19 nt, Homo sapiens
acugcggcaggugcagcca

SEQ ID NO: 2114 - RNA, 19 nt, Homo sapiens
cugcggcaggugcagccag

SEQ ID NO: 2115 - RNA, 19 nt, Homo sapiens
ugcggcaggugcagccagg

SEQ ID NO: 2116 - RNA, 19 nt, Homo sapiens
gcggcaggugcagccagga

SEQ ID NO: 2117 - RNA, 19 nt, Homo sapiens
cggcaggugcagccaggag

SEQ ID NO: 2118 - RNA, 19 nt, Homo sapiens
ggcaggugcagccaggagg

SEQ ID NO: 2119 - RNA, 19 nt, Homo sapiens
gcaggugcagccaggaggc

SEQ ID NO: 2120 - RNA, 19 nt, Homo sapiens
caggugcagccaggaggcc

SEQ ID NO: 2121 - RNA, 19 nt, Homo sapiens
aggugcagccaggaggccu

SEQ ID NO: 2122 - RNA, 19 nt, Homo sapiens
ggugcagccaggaggccug

SEQ ID NO: 2123 - RNA, 19 nt, Homo sapiens
gugcagccaggaggccugc

SEQ ID NO: 2124 - RNA, 19 nt, Homo sapiens
ugcagccaggaggccugcc

SEQ ID NO: 2125 - RNA, 19 nt, Homo sapiens
gcagccaggaggccugccc

SEQ ID NO: 2126 - RNA, 19 nt, Homo sapiens
cagccaggaggccugcccg

SEQ ID NO: 2127 - RNA, 19 nt, Homo sapiens
agccaggaggccugcccgg

SEQ ID NO: 2128 - RNA, 19 nt, Homo sapiens
gccaggaggccugcccgga

SEQ ID NO: 2129 - RNA, 19 nt, Homo sapiens
ccaggaggccugcccggac

SEQ ID NO: 2130 - RNA, 19 nt, Homo sapiens
caggaggccugcccggaca

SEQ ID NO: 2131 - RNA, 19 nt, Homo sapiens
aggaggccugcccggacag

SEQ ID NO: 2132 - RNA, 19 nt, Homo sapiens
ggaggccugcccggacagc

SEQ ID NO: 2133 - RNA, 19 nt, Homo sapiens
gaggccugcccggacagcc

SEQ ID NO: 2134 - RNA, 19 nt, Homo sapiens
aggccugcccggacagcca

SEQ ID NO: 2135 - RNA, 19 nt, Homo sapiens
ggccugcccggacagccag

SEQ ID NO: 2136 - RNA, 19 nt, Homo sapiens
gccugcccggacagccagc

SEQ ID NO: 2137 - RNA, 19 nt, Homo sapiens
ccugcccggacagccagcc

SEQ ID NO: 2138 - RNA, 19 nt, Homo sapiens
cugcccggacagccagcca

SEQ ID NO: 2139 - RNA, 19 nt, Homo sapiens
ugcccggacagccagccag

SEQ ID NO: 2140 - RNA, 19 nt, Homo sapiens
gcccggacagccagccagc

SEQ ID NO: 2141 - RNA, 19 nt, Homo sapiens
cccggacagccagccagcc

SEQ ID NO: 2142 - RNA, 19 nt, Homo sapiens
ccggacagccagccagcca

SEQ ID NO: 2143 - RNA, 19 nt, Homo sapiens
cggacagccagccagccag

SEQ ID NO: 2144 - RNA, 19 nt, Homo sapiens
ggacagccagccagccagc

SEQ ID NO: 2145 - RNA, 19 nt, Homo sapiens
gacagccagccagccagcc

SEQ ID NO: 2146 - RNA, 19 nt, Homo sapiens
acagccagccagccagcca

SEQ ID NO: 2147 - RNA, 19 nt, Homo sapiens
cagccagccagccagccag

SEQ ID NO: 2148 - RNA, 19 nt, Homo sapiens
agccagccagccagccagc

SEQ ID NO: 2149 - RNA, 19 nt, Homo sapiens
gccagccagccagccagcc

SEQ ID NO: 2150 - RNA, 19 nt, Homo sapiens
ccagccagccagccagccg

SEQ ID NO: 2151 - RNA, 19 nt, Homo sapiens
cagccagccagccagccgc

SEQ ID NO: 2152 - RNA, 19 nt, Homo sapiens
agccagccagccagccgcc

SEQ ID NO: 2153 - RNA, 19 nt, Homo sapiens
gccagccagccagccgccc

SEQ ID NO: 2154 - RNA, 19 nt, Homo sapiens
ccagccagccagccgcccu

SEQ ID NO: 2155 - RNA, 19 nt, Homo sapiens
cagccagccagccgcccuu

SEQ ID NO: 2156 - RNA, 19 nt, Homo sapiens
agccagccagccgcccuug

SEQ ID NO: 2157 - RNA, 19 nt, Homo sapiens
gccagccagccgcccuugu

SEQ ID NO: 2158 - RNA, 19 nt, Homo sapiens
ccagccagccgcccuugua

SEQ ID NO: 2159 - RNA, 19 nt, Homo sapiens
cagccagccgcccuuguaa

SEQ ID NO: 2160 - RNA, 19 nt, Homo sapiens
agccagccgcccuuguaaa

SEQ ID NO: 2161 - RNA, 19 nt, Homo sapiens
gccagccgcccuuguaaag

SEQ ID NO: 2162 - RNA, 19 nt, Homo sapiens
ccagccgcccuuguaaagg

SEQ ID NO: 2163 - RNA, 19 nt, Homo sapiens
cagccgcccuuguaaaggc

SEQ ID NO: 2164 - RNA, 19 nt, Homo sapiens
agccgcccuuguaaaggcc

SEQ ID NO: 2165 - RNA, 19 nt, Homo sapiens
gccgcccuuguaaaggccc

SEQ ID NO: 2166 - RNA, 19 nt, Homo sapiens
ccgcccuuguaaaggccca

SEQ ID NO: 2167 - RNA, 19 nt, Homo sapiens
cgcccuuguaaaggcccac

SEQ ID NO: 2168 - RNA, 19 nt, Homo sapiens
gcccuuguaaaggcccaca

SEQ ID NO: 2169 - RNA, 19 nt, Homo sapiens
cccuuguaaaggcccacag

SEQ ID NO: 2170 - RNA, 19 nt, Homo sapiens
ccuuguaaaggcccacagg

SEQ ID NO: 2171 - RNA, 19 nt, Homo sapiens
cuuguaaaggcccacaggc

SEQ ID NO: 2172 - RNA, 19 nt, Homo sapiens
uuguaaaggcccacaggca

SEQ ID NO: 2173 - RNA, 19 nt, Homo sapiens
uguaaaggcccacaggcag

SEQ ID NO: 2174 - RNA, 19 nt, Homo sapiens
guaaaggcccacaggcagg

SEQ ID NO: 2175 - RNA, 19 nt, Homo sapiens
uaaaggcccacaggcaggc

SEQ ID NO: 2176 - RNA, 19 nt, Homo sapiens
aaaggcccacaggcaggca

SEQ ID NO: 2177 - RNA, 19 nt, Homo sapiens
aaggcccacaggcaggcag

SEQ ID NO: 2178 - RNA, 19 nt, Homo sapiens
aggcccacaggcaggcagg

SEQ ID NO: 2179 - RNA, 19 nt, Homo sapiens
ggcccacaggcaggcaggc

SEQ ID NO: 2180 - RNA, 19 nt, Homo sapiens
gcccacaggcaggcaggcu

SEQ ID NO: 2181 - RNA, 19 nt, Homo sapiens
cccacaggcaggcaggcuc

SEQ ID NO: 2182 - RNA, 19 nt, Homo sapiens
ccacaggcaggcaggcucc

SEQ ID NO: 2183 - RNA, 19 nt, Homo sapiens
cacaggcaggcaggcucca

SEQ ID NO: 2184 - RNA, 19 nt, Homo sapiens
acaggcaggcaggcuccac

SEQ ID NO: 2185 - RNA, 19 nt, Homo sapiens
caggcaggcaggcuccacc

SEQ ID NO: 2186 - RNA, 19 nt, Homo sapiens
aggcaggcaggcuccaccc

SEQ ID NO: 2187 - RNA, 19 nt, Homo sapiens
ggcaggcaggcuccacccc

SEQ ID NO: 2188 - RNA, 19 nt, Homo sapiens
gcaggcaggcuccaccccu

SEQ ID NO: 2189 - RNA, 19 nt, Homo sapiens
caggcaggcuccaccccuu

SEQ ID NO: 2190 - RNA, 19 nt, Homo sapiens
aggcaggcuccaccccuuc

SEQ ID NO: 2191 - RNA, 19 nt, Homo sapiens
ggcaggcuccaccccuuca

SEQ ID NO: 2192 - RNA, 19 nt, Homo sapiens
gcaggcuccaccccuucau

SEQ ID NO: 2193 - RNA, 20 nt, Homo sapiens
gagauguaacucuaauccag

SEQ ID NO: 2194 - RNA, 20 nt, Homo sapiens
agauguaacucuaauccagg

SEQ ID NO: 2195 - RNA, 20 nt, Homo sapiens
gauguaacucuaauccaggu

SEQ ID NO: 2196 - RNA, 20 nt, Homo sapiens
auguaacucuaauccagguu

SEQ ID NO: 2197 - RNA, 20 nt, Homo sapiens
uguaacucuaauccagguuu

SEQ ID NO: 2198 - RNA, 20 nt, Homo sapiens
guaacucuaauccagguuug

SEQ ID NO: 2199 - RNA, 20 nt, Homo sapiens
uaacucuaauccagguuugc

SEQ ID NO: 2200 - RNA, 20 nt, Homo sapiens
aacucuaauccagguuugcc

SEQ ID NO: 2201 - RNA, 20 nt, Homo sapiens
acucuaauccagguuugccu

SEQ ID NO: 2202 - RNA, 20 nt, Homo sapiens
cucuaauccagguuugccua

SEQ ID NO: 2203 - RNA, 20 nt, Homo sapiens
ucuaauccagguuugccuag

SEQ ID NO: 2204 - RNA, 20 nt, Homo sapiens
cuaauccagguuugccuaga

SEQ ID NO: 2205 - RNA, 20 nt, Homo sapiens
uaauccagguuugccuagac

SEQ ID NO: 2206 - RNA, 20 nt, Homo sapiens
aauccagguuugccuagaca

SEQ ID NO: 2207 - RNA, 20 nt, Homo sapiens
auccagguuugccuagacag

SEQ ID NO: 2208 - RNA, 20 nt, Homo sapiens
uccagguuugccuagacagc

SEQ ID NO: 2209 - RNA, 20 nt, Homo sapiens
ccagguuugccuagacagcg

SEQ ID NO: 2210 - RNA, 20 nt, Homo sapiens
cagguuugccuagacagcgu

SEQ ID NO: 2211 - RNA, 20 nt, Homo sapiens
agguuugccuagacagcguc

SEQ ID NO: 2212 - RNA, 20 nt, Homo sapiens
gguuugccuagacagcgucg

SEQ ID NO: 2213 - RNA, 20 nt, Homo sapiens
guuugccuagacagcgucgg

SEQ ID NO: 2214 - RNA, 20 nt, Homo sapiens
uuugccuagacagcgucgga

SEQ ID NO: 2215 - RNA, 20 nt, Homo sapiens
uugccuagacagcgucggaa

SEQ ID NO: 2216 - RNA, 20 nt, Homo sapiens
ugccuagacagcgucggaag

SEQ ID NO: 2217 - RNA, 20 nt, Homo sapiens
gccuagacagcgucggaagg

SEQ ID NO: 2218 - RNA, 20 nt, Homo sapiens
ccuagacagcgucggaaggu

SEQ ID NO: 2219 - RNA, 20 nt, Homo sapiens
cuagacagcgucggaaggug

SEQ ID NO: 2220 - RNA, 20 nt, Homo sapiens
uagacagcgucggaaggugg

SEQ ID NO: 2221 - RNA, 20 nt, Homo sapiens
agacagcgucggaagguggg

SEQ ID NO: 2222 - RNA, 20 nt, Homo sapiens
gacagcgucggaaggugggg

SEQ ID NO: 2223 - RNA, 20 nt, Homo sapiens
acagcgucggaagguggggg

SEQ ID NO: 2224 - RNA, 20 nt, Homo sapiens
cagcgucggaaggugggggg

SEQ ID NO: 2225 - RNA, 20 nt, Homo sapiens
agcgucggaaggugggggga

SEQ ID NO: 2226 - RNA, 20 nt, Homo sapiens
gcgucggaagguggggggag

SEQ ID NO: 2227 - RNA, 20 nt, Homo sapiens
cgucggaagguggggggaga

SEQ ID NO: 2228 - RNA, 20 nt, Homo sapiens
gucggaagguggggggagac

SEQ ID NO: 2229 - RNA, 20 nt, Homo sapiens
ucggaagguggggggagaca

SEQ ID NO: 2230 - RNA, 20 nt, Homo sapiens
cggaagguggggggagacau

SEQ ID NO: 2231 - RNA, 20 nt, Homo sapiens
ggaagguggggggagacauu

SEQ ID NO: 2232 - RNA, 20 nt, Homo sapiens
gaagguggggggagacauuc

SEQ ID NO: 2233 - RNA, 20 nt, Homo sapiens
aagguggggggagacauuca

SEQ ID NO: 2234 - RNA, 20 nt, Homo sapiens
agguggggggagacauucag

SEQ ID NO: 2235 - RNA, 20 nt, Homo sapiens
gguggggggagacauucagc

SEQ ID NO: 2236 - RNA, 20 nt, Homo sapiens
guggggggagacauucagcc

SEQ ID NO: 2237 - RNA, 20 nt, Homo sapiens
uggggggagacauucagcca

SEQ ID NO: 2238 - RNA, 20 nt, Homo sapiens
ggggggagacauucagccag

SEQ ID NO: 2239 - RNA, 20 nt, Homo sapiens
gggggagacauucagccaga

SEQ ID NO: 2240 - RNA, 20 nt, Homo sapiens
ggggagacauucagccagaa

SEQ ID NO: 2241 - RNA, 20 nt, Homo sapiens
gggagacauucagccagaau

SEQ ID NO: 2242 - RNA, 20 nt, Homo sapiens
ggagacauucagccagaauu

SEQ ID NO: 2243 - RNA, 20 nt, Homo sapiens
gagacauucagccagaauuu

SEQ ID NO: 2244 - RNA, 20 nt, Homo sapiens
agacauucagccagaauuuc

SEQ ID NO: 2245 - RNA, 20 nt, Homo sapiens
gacauucagccagaauuuca

SEQ ID NO: 2246 - RNA, 20 nt, Homo sapiens
acauucagccagaauuucac

SEQ ID NO: 2247 - RNA, 20 nt, Homo sapiens
cauucagccagaauuucacg

SEQ ID NO: 2248 - RNA, 20 nt, Homo sapiens
auucagccagaauuucacgg

SEQ ID NO: 2249 - RNA, 20 nt, Homo sapiens
uucagccagaauuucacgga

SEQ ID NO: 2250 - RNA, 20 nt, Homo sapiens
ucagccagaauuucacggaa

SEQ ID NO: 2251 - RNA, 20 nt, Homo sapiens
cagccagaauuucacggaag

SEQ ID NO: 2252 - RNA, 20 nt, Homo sapiens
agccagaauuucacggaaga

SEQ ID NO: 2253 - RNA, 20 nt, Homo sapiens
gccagaauuucacggaagaa

SEQ ID NO: 2254 - RNA, 20 nt, Homo sapiens
ccagaauuucacggaagaac

SEQ ID NO: 2255 - RNA, 20 nt, Homo sapiens
cagaauuucacggaagaaca

SEQ ID NO: 2256 - RNA, 20 nt, Homo sapiens
agaauuucacggaagaacaa

SEQ ID NO: 2257 - RNA, 20 nt, Homo sapiens
gaauuucacggaagaacaag

SEQ ID NO: 2258 - RNA, 20 nt, Homo sapiens
aauuucacggaagaacaagg

SEQ ID NO: 2259 - RNA, 20 nt, Homo sapiens
auuucacggaagaacaaggg

SEQ ID NO: 2260 - RNA, 20 nt, Homo sapiens
uuucacggaagaacaagggc

SEQ ID NO: 2261 - RNA, 20 nt, Homo sapiens
uucacggaagaacaagggca

SEQ ID NO: 2262 - RNA, 20 nt, Homo sapiens
ucacggaagaacaagggcac

SEQ ID NO: 2263 - RNA, 20 nt, Homo sapiens
cacggaagaacaagggcaca

SEQ ID NO: 2264 - RNA, 20 nt, Homo sapiens
acggaagaacaagggcacag

SEQ ID NO: 2265 - RNA, 20 nt, Homo sapiens
cggaagaacaagggcacaga

SEQ ID NO: 2266 - RNA, 20 nt, Homo sapiens
ggaagaacaagggcacagag

SEQ ID NO: 2267 - RNA, 20 nt, Homo sapiens
gaagaacaagggcacagaga

SEQ ID NO: 2268 - RNA, 20 nt, Homo sapiens
aagaacaagggcacagagag

SEQ ID NO: 2269 - RNA, 20 nt, Homo sapiens
agaacaagggcacagagagg

SEQ ID NO: 2270 - RNA, 20 nt, Homo sapiens
gaacaagggcacagagaggc

SEQ ID NO: 2271 - RNA, 20 nt, Homo sapiens
aacaagggcacagagaggcc

SEQ ID NO: 2272 - RNA, 20 nt, Homo sapiens
acaagggcacagagaggcca

SEQ ID NO: 2273 - RNA, 20 nt, Homo sapiens
caagggcacagagaggccag

SEQ ID NO: 2274 - RNA, 20 nt, Homo sapiens
aagggcacagagaggccagc

SEQ ID NO: 2275 - RNA, 20 nt, Homo sapiens
agggcacagagaggccagcg

SEQ ID NO: 2276 - RNA, 20 nt, Homo sapiens
gggcacagagaggccagcga

SEQ ID NO: 2277 - RNA, 20 nt, Homo sapiens
ggcacagagaggccagcgag

SEQ ID NO: 2278 - RNA, 20 nt, Homo sapiens
gcacagagaggccagcgagc

SEQ ID NO: 2279 - RNA, 20 nt, Homo sapiens
cacagagaggccagcgagcu

SEQ ID NO: 2280 - RNA, 20 nt, Homo sapiens
acagagaggccagcgagcuc

SEQ ID NO: 2281 - RNA, 20 nt, Homo sapiens
cagagaggccagcgagcucc

SEQ ID NO: 2282 - RNA, 20 nt, Homo sapiens
agagaggccagcgagcuccc

SEQ ID NO: 2283 - RNA, 20 nt, Homo sapiens
gagaggccagcgagcucccu

SEQ ID NO: 2284 - RNA, 20 nt, Homo sapiens
agaggccagcgagcucccuu

SEQ ID NO: 2285 - RNA, 20 nt, Homo sapiens
gaggccagcgagcucccuug

SEQ ID NO: 2286 - RNA, 20 nt, Homo sapiens
aggccagcgagcucccuugc

SEQ ID NO: 2287 - RNA, 20 nt, Homo sapiens
ggccagcgagcucccuugca

SEQ ID NO: 2288 - RNA, 20 nt, Homo sapiens
gccagcgagcucccuugcac

SEQ ID NO: 2289 - RNA, 20 nt, Homo sapiens
ccagcgagcucccuugcacg

SEQ ID NO: 2290 - RNA, 20 nt, Homo sapiens
cagcgagcucccuugcacgu

SEQ ID NO: 2291 - RNA, 20 nt, Homo sapiens
agcgagcucccuugcacguc

SEQ ID NO: 2292 - RNA, 20 nt, Homo sapiens
gcgagcucccuugcacguca

SEQ ID NO: 2293 - RNA, 20 nt, Homo sapiens
cgagcucccuugcacgucag

SEQ ID NO: 2294 - RNA, 20 nt, Homo sapiens
gagcucccuugcacgucagc

SEQ ID NO: 2295 - RNA, 20 nt, Homo sapiens
agcucccuugcacgucagcc

SEQ ID NO: 2296 - RNA, 20 nt, Homo sapiens
gcucccuugcacgucagccg

SEQ ID NO: 2297 - RNA, 20 nt, Homo sapiens
cucccuugcacgucagccgg

SEQ ID NO: 2298 - RNA, 20 nt, Homo sapiens
ucccuugcacgucagccggg

SEQ ID NO: 2299 - RNA, 20 nt, Homo sapiens
cccuugcacgucagccgggg

SEQ ID NO: 2300 - RNA, 20 nt, Homo sapiens
ccuugcacgucagccggggu

SEQ ID NO: 2301 - RNA, 20 nt, Homo sapiens
cuugcacgucagccggggug

SEQ ID NO: 2302 - RNA, 20 nt, Homo sapiens
uugcacgucagccggggugc

SEQ ID NO: 2303 - RNA, 20 nt, Homo sapiens
ugcacgucagccggggugcg

SEQ ID NO: 2304 - RNA, 20 nt, Homo sapiens
gcacgucagccggggugcgc

SEQ ID NO: 2305 - RNA, 20 nt, Homo sapiens
cacgucagccggggugcgca

SEQ ID NO: 2306 - RNA, 20 nt, Homo sapiens
acgucagccggggugcgcac

SEQ ID NO: 2307 - RNA, 20 nt, Homo sapiens
cgucagccggggugcgcacu

SEQ ID NO: 2308 - RNA, 20 nt, Homo sapiens
gucagccggggugcgcacug

SEQ ID NO: 2309 - RNA, 20 nt, Homo sapiens
ucagccggggugcgcacugc

SEQ ID NO: 2310 - RNA, 20 nt, Homo sapiens
cagccggggugcgcacugcg

SEQ ID NO: 2311 - RNA, 20 nt, Homo sapiens
agccggggugcgcacugcgc

SEQ ID NO: 2312 - RNA, 20 nt, Homo sapiens
gccggggugcgcacugcgcg

SEQ ID NO: 2313 - RNA, 20 nt, Homo sapiens
ccggggugcgcacugcgcgc

SEQ ID NO: 2314 - RNA, 20 nt, Homo sapiens
cggggugcgcacugcgcgca

SEQ ID NO: 2315 - RNA, 20 nt, Homo sapiens
ggggugcgcacugcgcgcag

SEQ ID NO: 2316 - RNA, 20 nt, Homo sapiens
gggugcgcacugcgcgcagg

SEQ ID NO: 2317 - RNA, 20 nt, Homo sapiens
ggugcgcacugcgcgcaggu

SEQ ID NO: 2318 - RNA, 20 nt, Homo sapiens
gugcgcacugcgcgcagguc

SEQ ID NO: 2319 - RNA, 20 nt, Homo sapiens
ugcgcacugcgcgcaggucu

SEQ ID NO: 2320 - RNA, 20 nt, Homo sapiens
gcgcacugcgcgcaggucua

SEQ ID NO: 2321 - RNA, 20 nt, Homo sapiens
cgcacugcgcgcaggucuag

SEQ ID NO: 2322 - RNA, 20 nt, Homo sapiens
gcacugcgcgcaggucuagc

SEQ ID NO: 2323 - RNA, 20 nt, Homo sapiens
cacugcgcgcaggucuagcc

SEQ ID NO: 2324 - RNA, 20 nt, Homo sapiens
acugcgcgcaggucuagcca

SEQ ID NO: 2325 - RNA, 20 nt, Homo sapiens
cugcgcgcaggucuagccag

SEQ ID NO: 2326 - RNA, 20 nt, Homo sapiens
ugcgcgcaggucuagccagg

SEQ ID NO: 2327 - RNA, 20 nt, Homo sapiens
gcgcgcaggucuagccagga

SEQ ID NO: 2328 - RNA, 20 nt, Homo sapiens
cgcgcaggucuagccaggaa

SEQ ID NO: 2329 - RNA, 20 nt, Homo sapiens
gcgcaggucuagccaggaag

SEQ ID NO: 2330 - RNA, 20 nt, Homo sapiens
cgcaggucuagccaggaagc

SEQ ID NO: 2331 - RNA, 20 nt, Homo sapiens
gcaggucuagccaggaagcg

SEQ ID NO: 2332 - RNA, 20 nt, Homo sapiens
caggucuagccaggaagcgg

SEQ ID NO: 2333 - RNA, 20 nt, Homo sapiens
aggucuagccaggaagcggg

SEQ ID NO: 2334 - RNA, 20 nt, Homo sapiens
ggucuagccaggaagcgggc

SEQ ID NO: 2335 - RNA, 20 nt, Homo sapiens
gucuagccaggaagcgggca

SEQ ID NO: 2336 - RNA, 20 nt, Homo sapiens
ucuagccaggaagcgggcaa

SEQ ID NO: 2337 - RNA, 20 nt, Homo sapiens
cuagccaggaagcgggcaaa

SEQ ID NO: 2338 - RNA, 20 nt, Homo sapiens
uagccaggaagcgggcaaag

SEQ ID NO: 2339 - RNA, 20 nt, Homo sapiens
agccaggaagcgggcaaaga

SEQ ID NO: 2340 - RNA, 20 nt, Homo sapiens
gccaggaagcgggcaaagac

SEQ ID NO: 2341 - RNA, 20 nt, Homo sapiens
ccaggaagcgggcaaagaca

SEQ ID NO: 2342 - RNA, 20 nt, Homo sapiens
caggaagcgggcaaagacag

SEQ ID NO: 2343 - RNA, 20 nt, Homo sapiens
aggaagcgggcaaagacaga

SEQ ID NO: 2344 - RNA, 20 nt, Homo sapiens
ggaagcgggcaaagacagac

SEQ ID NO: 2345 - RNA, 20 nt, Homo sapiens
gaagcgggcaaagacagaca

SEQ ID NO: 2346 - RNA, 20 nt, Homo sapiens
aagcgggcaaagacagacag

SEQ ID NO: 2347 - RNA, 20 nt, Homo sapiens
agcgggcaaagacagacaga

SEQ ID NO: 2348 - RNA, 20 nt, Homo sapiens
gcgggcaaagacagacagag

SEQ ID NO: 2349 - RNA, 20 nt, Homo sapiens
cgggcaaagacagacagagg

SEQ ID NO: 2350 - RNA, 20 nt, Homo sapiens
gggcaaagacagacagaggu

SEQ ID NO: 2351 - RNA, 20 nt, Homo sapiens
ggcaaagacagacagaggua

SEQ ID NO: 2352 - RNA, 20 nt, Homo sapiens
gcaaagacagacagagguau

SEQ ID NO: 2353 - RNA, 20 nt, Homo sapiens
caaagacagacagagguaug

SEQ ID NO: 2354 - RNA, 20 nt, Homo sapiens
aaagacagacagagguaugc

SEQ ID NO: 2355 - RNA, 20 nt, Homo sapiens
aagacagacagagguaugcu

SEQ ID NO: 2356 - RNA, 20 nt, Homo sapiens
agacagacagagguaugcuu

SEQ ID NO: 2357 - RNA, 20 nt, Homo sapiens
gacagacagagguaugcuuu

SEQ ID NO: 2358 - RNA, 20 nt, Homo sapiens
acagacagagguaugcuuuu

SEQ ID NO: 2359 - RNA, 20 nt, Homo sapiens
cagacagagguaugcuuuug

SEQ ID NO: 2360 - RNA, 20 nt, Homo sapiens
agacagagguaugcuuuuga

SEQ ID NO: 2361 - RNA, 20 nt, Homo sapiens
gacagagguaugcuuuugac

SEQ ID NO: 2362 - RNA, 20 nt, Homo sapiens
acagagguaugcuuuugacc

SEQ ID NO: 2363 - RNA, 20 nt, Homo sapiens
cagagguaugcuuuugaccg

SEQ ID NO: 2364 - RNA, 20 nt, Homo sapiens
agagguaugcuuuugaccgc

SEQ ID NO: 2365 - RNA, 20 nt, Homo sapiens
gagguaugcuuuugaccgcc

SEQ ID NO: 2366 - RNA, 20 nt, Homo sapiens
agguaugcuuuugaccgcca

SEQ ID NO: 2367 - RNA, 20 nt, Homo sapiens
gguaugcuuuugaccgccag

SEQ ID NO: 2368 - RNA, 20 nt, Homo sapiens
guaugcuuuugaccgccagg

SEQ ID NO: 2369 - RNA, 20 nt, Homo sapiens
uaugcuuuugaccgccagga

SEQ ID NO: 2370 - RNA, 20 nt, Homo sapiens
augcuuuugaccgccaggag

SEQ ID NO: 2371 - RNA, 20 nt, Homo sapiens
ugcuuuugaccgccaggagc

SEQ ID NO: 2372 - RNA, 20 nt, Homo sapiens
gcuuuugaccgccaggagcu

SEQ ID NO: 2373 - RNA, 20 nt, Homo sapiens
cuuuugaccgccaggagcuc

SEQ ID NO: 2374 - RNA, 20 nt, Homo sapiens
uuuugaccgccaggagcucc

SEQ ID NO: 2375 - RNA, 20 nt, Homo sapiens
uuugaccgccaggagcuccg

SEQ ID NO: 2376 - RNA, 20 nt, Homo sapiens
uugaccgccaggagcuccgc

SEQ ID NO: 2377 - RNA, 20 nt, Homo sapiens
ugaccgccaggagcuccgcg

SEQ ID NO: 2378 - RNA, 20 nt, Homo sapiens
gaccgccaggagcuccgcgc

SEQ ID NO: 2379 - RNA, 20 nt, Homo sapiens
accgccaggagcuccgcgcu

SEQ ID NO: 2380 - RNA, 20 nt, Homo sapiens
ccgccaggagcuccgcgcug

SEQ ID NO: 2381 - RNA, 20 nt, Homo sapiens
cgccaggagcuccgcgcugg

SEQ ID NO: 2382 - RNA, 20 nt, Homo sapiens
gccaggagcuccgcgcuggc

SEQ ID NO: 2383 - RNA, 20 nt, Homo sapiens
ccaggagcuccgcgcuggca

SEQ ID NO: 2384 - RNA, 20 nt, Homo sapiens
caggagcuccgcgcuggcag

SEQ ID NO: 2385 - RNA, 20 nt, Homo sapiens
aggagcuccgcgcuggcagc

SEQ ID NO: 2386 - RNA, 20 nt, Homo sapiens
ggagcuccgcgcuggcagcu

SEQ ID NO: 2387 - RNA, 20 nt, Homo sapiens
gagcuccgcgcuggcagcug

SEQ ID NO: 2388 - RNA, 20 nt, Homo sapiens
agcuccgcgcuggcagcugg

SEQ ID NO: 2389 - RNA, 20 nt, Homo sapiens
gcuccgcgcuggcagcuggg

SEQ ID NO: 2390 - RNA, 20 nt, Homo sapiens
cuccgcgcuggcagcuggga

SEQ ID NO: 2391 - RNA, 20 nt, Homo sapiens
uccgcgcuggcagcugggag

SEQ ID NO: 2392 - RNA, 20 nt, Homo sapiens
ccgcgcuggcagcugggagg

SEQ ID NO: 2393 - RNA, 20 nt, Homo sapiens
cgcgcuggcagcugggaggc

SEQ ID NO: 2394 - RNA, 20 nt, Homo sapiens
gcgcuggcagcugggaggcu

SEQ ID NO: 2395 - RNA, 20 nt, Homo sapiens
cgcuggcagcugggaggcug

SEQ ID NO: 2396 - RNA, 20 nt, Homo sapiens
gcuggcagcugggaggcugc

SEQ ID NO: 2397 - RNA, 20 nt, Homo sapiens
cuggcagcugggaggcugca

SEQ ID NO: 2398 - RNA, 20 nt, Homo sapiens
uggcagcugggaggcugcag

SEQ ID NO: 2399 - RNA, 20 nt, Homo sapiens
ggcagcugggaggcugcagg

SEQ ID NO: 2400 - RNA, 20 nt, Homo sapiens
gcagcugggaggcugcaggg

SEQ ID NO: 2401 - RNA, 20 nt, Homo sapiens
cagcugggaggcugcagggg

SEQ ID NO: 2402 - RNA, 20 nt, Homo sapiens
agcugggaggcugcaggggc

SEQ ID NO: 2403 - RNA, 20 nt, Homo sapiens
gcugggaggcugcaggggcc

SEQ ID NO: 2404 - RNA, 20 nt, Homo sapiens
cugggaggcugcaggggccc

SEQ ID NO: 2405 - RNA, 20 nt, Homo sapiens
ugggaggcugcaggggcccg

SEQ ID NO: 2406 - RNA, 20 nt, Homo sapiens
gggaggcugcaggggcccgg

SEQ ID NO: 2407 - RNA, 20 nt, Homo sapiens
ggaggcugcaggggcccggg

SEQ ID NO: 2408 - RNA, 20 nt, Homo sapiens
gaggcugcaggggcccgggc

SEQ ID NO: 2409 - RNA, 20 nt, Homo sapiens
aggcugcaggggcccgggcg

SEQ ID NO: 2410 - RNA, 20 nt, Homo sapiens
ggcugcaggggcccgggcgg

SEQ ID NO: 2411 - RNA, 20 nt, Homo sapiens
gcugcaggggcccgggcggg

SEQ ID NO: 2412 - RNA, 20 nt, Homo sapiens
cugcaggggcccgggcgggc

SEQ ID NO: 2413 - RNA, 20 nt, Homo sapiens
ugcaggggcccgggcgggcg

SEQ ID NO: 2414 - RNA, 20 nt, Homo sapiens
gcaggggcccgggcgggcgg

SEQ ID NO: 2415 - RNA, 20 nt, Homo sapiens
caggggcccgggcgggcggg

SEQ ID NO: 2416 - RNA, 20 nt, Homo sapiens
aggggcccgggcgggcgggc

SEQ ID NO: 2417 - RNA, 20 nt, Homo sapiens
ggggcccgggcgggcgggcg

SEQ ID NO: 2418 - RNA, 20 nt, Homo sapiens
gggcccgggcgggcgggcga

SEQ ID NO: 2419 - RNA, 20 nt, Homo sapiens
ggcccgggcgggcgggcgac

SEQ ID NO: 2420 - RNA, 20 nt, Homo sapiens
gcccgggcgggcgggcgacg

SEQ ID NO: 2421 - RNA, 20 nt, Homo sapiens
cccgggcgggcgggcgacgg

SEQ ID NO: 2422 - RNA, 20 nt, Homo sapiens
ccgggcgggcgggcgacggu

SEQ ID NO: 2423 - RNA, 20 nt, Homo sapiens
cgggcgggcgggcgacggug

SEQ ID NO: 2424 - RNA, 20 nt, Homo sapiens
gggcgggcgggcgacggugg

SEQ ID NO: 2425 - RNA, 20 nt, Homo sapiens
ggcgggcgggcgacgguggc

SEQ ID NO: 2426 - RNA, 20 nt, Homo sapiens
gcgggcgggcgacgguggcg

SEQ ID NO: 2427 - RNA, 20 nt, Homo sapiens
cgggcgggcgacgguggcgc

SEQ ID NO: 2428 - RNA, 20 nt, Homo sapiens
gggcgggcgacgguggcgcg

SEQ ID NO: 2429 - RNA, 20 nt, Homo sapiens
ggcgggcgacgguggcgcgg

SEQ ID NO: 2430 - RNA, 20 nt, Homo sapiens
gcgggcgacgguggcgcggg

SEQ ID NO: 2431 - RNA, 20 nt, Homo sapiens
cgggcgacgguggcgcgggg

SEQ ID NO: 2432 - RNA, 20 nt, Homo sapiens
gggcgacgguggcgcggggg

SEQ ID NO: 2433 - RNA, 20 nt, Homo sapiens
ggcgacgguggcgcgggggc

SEQ ID NO: 2434 - RNA, 20 nt, Homo sapiens
gcgacgguggcgcgggggca

SEQ ID NO: 2435 - RNA, 20 nt, Homo sapiens
cgacgguggcgcgggggcac

SEQ ID NO: 2436 - RNA, 20 nt, Homo sapiens
gacgguggcgcgggggcaca

SEQ ID NO: 2437 - RNA, 20 nt, Homo sapiens
acgguggcgcgggggcacac

SEQ ID NO: 2438 - RNA, 20 nt, Homo sapiens
cgguggcgcgggggcacaca

SEQ ID NO: 2439 - RNA, 20 nt, Homo sapiens
gguggcgcgggggcacacag

SEQ ID NO: 2440 - RNA, 20 nt, Homo sapiens
guggcgcgggggcacacagg

SEQ ID NO: 2441 - RNA, 20 nt, Homo sapiens
uggcgcgggggcacacagga

SEQ ID NO: 2442 - RNA, 20 nt, Homo sapiens
ggcgcgggggcacacaggag

SEQ ID NO: 2443 - RNA, 20 nt, Homo sapiens
gcgcgggggcacacaggagg

SEQ ID NO: 2444 - RNA, 20 nt, Homo sapiens
cgcgggggcacacaggaggc

SEQ ID NO: 2445 - RNA, 20 nt, Homo sapiens
gcgggggcacacaggaggcg

SEQ ID NO: 2446 - RNA, 20 nt, Homo sapiens
cgggggcacacaggaggcga

SEQ ID NO: 2447 - RNA, 20 nt, Homo sapiens
gggggcacacaggaggcgag

SEQ ID NO: 2448 - RNA, 20 nt, Homo sapiens
ggggcacacaggaggcgagc

SEQ ID NO: 2449 - RNA, 20 nt, Homo sapiens
gggcacacaggaggcgagcc

SEQ ID NO: 2450 - RNA, 20 nt, Homo sapiens
ggcacacaggaggcgagccg

SEQ ID NO: 2451 - RNA, 20 nt, Homo sapiens
gcacacaggaggcgagccgc

SEQ ID NO: 2452 - RNA, 20 nt, Homo sapiens
cacacaggaggcgagccgcc

SEQ ID NO: 2453 - RNA, 20 nt, Homo sapiens
acacaggaggcgagccgccg

SEQ ID NO: 2454 - RNA, 20 nt, Homo sapiens
cacaggaggcgagccgccgg

SEQ ID NO: 2455 - RNA, 20 nt, Homo sapiens
acaggaggcgagccgccgga

SEQ ID NO: 2456 - RNA, 20 nt, Homo sapiens
caggaggcgagccgccggag

SEQ ID NO: 2457 - RNA, 20 nt, Homo sapiens
aggaggcgagccgccggagc

SEQ ID NO: 2458 - RNA, 20 nt, Homo sapiens
ggaggcgagccgccggagcg

SEQ ID NO: 2459 - RNA, 20 nt, Homo sapiens
gaggcgagccgccggagcgg

SEQ ID NO: 2460 - RNA, 20 nt, Homo sapiens
aggcgagccgccggagcgga

SEQ ID NO: 2461 - RNA, 20 nt, Homo sapiens
ggcgagccgccggagcggag

SEQ ID NO: 2462 - RNA, 20 nt, Homo sapiens
gcgagccgccggagcggagu

SEQ ID NO: 2463 - RNA, 20 nt, Homo sapiens
cgagccgccggagcggaguc

SEQ ID NO: 2464 - RNA, 20 nt, Homo sapiens
gagccgccggagcggaguca

SEQ ID NO: 2465 - RNA, 20 nt, Homo sapiens
agccgccggagcggagucag

SEQ ID NO: 2466 - RNA, 20 nt, Homo sapiens
gccgccggagcggagucagg

SEQ ID NO: 2467 - RNA, 20 nt, Homo sapiens
ccgccggagcggagucaggc

SEQ ID NO: 2468 - RNA, 20 nt, Homo sapiens
cgccggagcggagucaggcc

SEQ ID NO: 2469 - RNA, 20 nt, Homo sapiens
gccggagcggagucaggccc

SEQ ID NO: 2470 - RNA, 20 nt, Homo sapiens
ccggagcggagucaggcccg

SEQ ID NO: 2471 - RNA, 20 nt, Homo sapiens
cggagcggagucaggcccgg

SEQ ID NO: 2472 - RNA, 20 nt, Homo sapiens
ggagcggagucaggcccgga

SEQ ID NO: 2473 - RNA, 20 nt, Homo sapiens
gagcggagucaggcccggac

SEQ ID NO: 2474 - RNA, 20 nt, Homo sapiens
agcggagucaggcccggacg

SEQ ID NO: 2475 - RNA, 20 nt, Homo sapiens
gcggagucaggcccggacgc

SEQ ID NO: 2476 - RNA, 20 nt, Homo sapiens
cggagucaggcccggacgcu

SEQ ID NO: 2477 - RNA, 20 nt, Homo sapiens
ggagucaggcccggacgcug

SEQ ID NO: 2478 - RNA, 20 nt, Homo sapiens
gagucaggcccggacgcugc

SEQ ID NO: 2479 - RNA, 20 nt, Homo sapiens
agucaggcccggacgcugcg

SEQ ID NO: 2480 - RNA, 20 nt, Homo sapiens
gucaggcccggacgcugcgc

SEQ ID NO: 2481 - RNA, 20 nt, Homo sapiens
ucaggcccggacgcugcgcg

SEQ ID NO: 2482 - RNA, 20 nt, Homo sapiens
caggcccggacgcugcgcgg

SEQ ID NO: 2483 - RNA, 20 nt, Homo sapiens
aggcccggacgcugcgcggg

SEQ ID NO: 2484 - RNA, 20 nt, Homo sapiens
ggcccggacgcugcgcgggg

SEQ ID NO: 2485 - RNA, 20 nt, Homo sapiens
gcccggacgcugcgcggggc

SEQ ID NO: 2486 - RNA, 20 nt, Homo sapiens
cccggacgcugcgcggggcc

SEQ ID NO: 2487 - RNA, 20 nt, Homo sapiens
ccggacgcugcgcggggccc

SEQ ID NO: 2488 - RNA, 20 nt, Homo sapiens
cggacgcugcgcggggcccg

SEQ ID NO: 2489 - RNA, 20 nt, Homo sapiens
ggacgcugcgcggggcccgg

SEQ ID NO: 2490 - RNA, 20 nt, Homo sapiens
gacgcugcgcggggcccggu

SEQ ID NO: 2491 - RNA, 20 nt, Homo sapiens
acgcugcgcggggcccggug

SEQ ID NO: 2492 - RNA, 20 nt, Homo sapiens
cgcugcgcggggcccggugu

SEQ ID NO: 2493 - RNA, 20 nt, Homo sapiens
gcugcgcggggcccgguguu

SEQ ID NO: 2494 - RNA, 20 nt, Homo sapiens
cugcgcggggcccgguguuu

SEQ ID NO: 2495 - RNA, 20 nt, Homo sapiens
ugcgcggggcccgguguuuc

SEQ ID NO: 2496 - RNA, 20 nt, Homo sapiens
gcgcggggcccgguguuucg

SEQ ID NO: 2497 - RNA, 20 nt, Homo sapiens
cgcggggcccgguguuucgc

SEQ ID NO: 2498 - RNA, 20 nt, Homo sapiens
gcggggcccgguguuucgcg

SEQ ID NO: 2499 - RNA, 20 nt, Homo sapiens
cggggcccgguguuucgcgg

SEQ ID NO: 2500 - RNA, 20 nt, Homo sapiens
ggggcccgguguuucgcggg

SEQ ID NO: 2501 - RNA, 20 nt, Homo sapiens
gggcccgguguuucgcggga

SEQ ID NO: 2502 - RNA, 20 nt, Homo sapiens
ggcccgguguuucgcgggac

SEQ ID NO: 2503 - RNA, 20 nt, Homo sapiens
gcccgguguuucgcgggacg

SEQ ID NO: 2504 - RNA, 20 nt, Homo sapiens
cccgguguuucgcgggacgg

SEQ ID NO: 2505 - RNA, 20 nt, Homo sapiens
ccgguguuucgcgggacggg

SEQ ID NO: 2506 - RNA, 20 nt, Homo sapiens
cgguguuucgcgggacgggg

SEQ ID NO: 2507 - RNA, 20 nt, Homo sapiens
gguguuucgcgggacggggg

SEQ ID NO: 2508 - RNA, 20 nt, Homo sapiens
guguuucgcgggacgggggu

SEQ ID NO: 2509 - RNA, 20 nt, Homo sapiens
uguuucgcgggacggggguc

SEQ ID NO: 2510 - RNA, 20 nt, Homo sapiens
guuucgcgggacgggggucu

SEQ ID NO: 2511 - RNA, 20 nt, Homo sapiens
uuucgcgggacgggggucuc

SEQ ID NO: 2512 - RNA, 20 nt, Homo sapiens
uucgcgggacgggggucucc

SEQ ID NO: 2513 - RNA, 20 nt, Homo sapiens
ucgcgggacgggggucucca

SEQ ID NO: 2514 - RNA, 20 nt, Homo sapiens
cgcgggacgggggucuccac

SEQ ID NO: 2515 - RNA, 20 nt, Homo sapiens
gcgggacgggggucuccacc

SEQ ID NO: 2516 - RNA, 20 nt, Homo sapiens
cgggacgggggucuccaccc

SEQ ID NO: 2517 - RNA, 20 nt, Homo sapiens
gggacgggggucuccaccca

SEQ ID NO: 2518 - RNA, 20 nt, Homo sapiens
ggacgggggucuccacccag

SEQ ID NO: 2519 - RNA, 20 nt, Homo sapiens
gacgggggucuccacccagc

SEQ ID NO: 2520 - RNA, 20 nt, Homo sapiens
acgggggucuccacccagcc

SEQ ID NO: 2521 - RNA, 20 nt, Homo sapiens
cgggggucuccacccagccc

SEQ ID NO: 2522 - RNA, 20 nt, Homo sapiens
gggggucuccacccagccca

SEQ ID NO: 2523 - RNA, 20 nt, Homo sapiens
ggggucuccacccagcccag

SEQ ID NO: 2524 - RNA, 20 nt, Homo sapiens
gggucuccacccagcccagg

SEQ ID NO: 2525 - RNA, 20 nt, Homo sapiens
ggucuccacccagcccaggg

SEQ ID NO: 2526 - RNA, 20 nt, Homo sapiens
gucuccacccagcccagggg

SEQ ID NO: 2527 - RNA, 20 nt, Homo sapiens
ucuccacccagcccagggga

SEQ ID NO: 2528 - RNA, 20 nt, Homo sapiens
cuccacccagcccaggggac

SEQ ID NO: 2529 - RNA, 20 nt, Homo sapiens
uccacccagcccaggggacg

SEQ ID NO: 2530 - RNA, 20 nt, Homo sapiens
ccacccagcccaggggacga

SEQ ID NO: 2531 - RNA, 20 nt, Homo sapiens
cacccagcccaggggacgac

SEQ ID NO: 2532 - RNA, 20 nt, Homo sapiens
acccagcccaggggacgacg

SEQ ID NO: 2533 - RNA, 20 nt, Homo sapiens
cccagcccaggggacgacgc

SEQ ID NO: 2534 - RNA, 20 nt, Homo sapiens
ccagcccaggggacgacgcg

SEQ ID NO: 2535 - RNA, 20 nt, Homo sapiens
cagcccaggggacgacgcgu

SEQ ID NO: 2536 - RNA, 20 nt, Homo sapiens
agcccaggggacgacgcguu

SEQ ID NO: 2537 - RNA, 20 nt, Homo sapiens
gcccaggggacgacgcguuu

SEQ ID NO: 2538 - RNA, 20 nt, Homo sapiens
cccaggggacgacgcguuuu

SEQ ID NO: 2539 - RNA, 20 nt, Homo sapiens
ccaggggacgacgcguuuuc

SEQ ID NO: 2540 - RNA, 20 nt, Homo sapiens
caggggacgacgcguuuucc

SEQ ID NO: 2541 - RNA, 20 nt, Homo sapiens
aggggacgacgcguuuuccg

SEQ ID NO: 2542 - RNA, 20 nt, Homo sapiens
ggggacgacgcguuuuccgg

SEQ ID NO: 2543 - RNA, 20 nt, Homo sapiens
gggacgacgcguuuuccggg

SEQ ID NO: 2544 - RNA, 20 nt, Homo sapiens
ggacgacgcguuuuccgggg

SEQ ID NO: 2545 - RNA, 20 nt, Homo sapiens
gacgacgcguuuuccggggg

SEQ ID NO: 2546 - RNA, 20 nt, Homo sapiens
acgacgcguuuuccgggggu

SEQ ID NO: 2547 - RNA, 20 nt, Homo sapiens
cgacgcguuuuccgggggug

SEQ ID NO: 2548 - RNA, 20 nt, Homo sapiens
gacgcguuuuccgggggugg

SEQ ID NO: 2549 - RNA, 20 nt, Homo sapiens
acgcguuuuccggggguggg

SEQ ID NO: 2550 - RNA, 20 nt, Homo sapiens
cgcguuuuccgggggugggg

SEQ ID NO: 2551 - RNA, 20 nt, Homo sapiens
gcguuuuccggggguggggg

SEQ ID NO: 2552 - RNA, 20 nt, Homo sapiens
cguuuuccgggggugggggg

SEQ ID NO: 2553 - RNA, 20 nt, Homo sapiens
guuuuccggggguggggggu

SEQ ID NO: 2554 - RNA, 20 nt, Homo sapiens
uuuuccggggguggggggug

SEQ ID NO: 2555 - RNA, 20 nt, Homo sapiens
uuuccggggguggggggugg

SEQ ID NO: 2556 - RNA, 20 nt, Homo sapiens
uuccgggggugggggguggg

SEQ ID NO: 2557 - RNA, 20 nt, Homo sapiens
uccggggguggggggugggg

SEQ ID NO: 2558 - RNA, 20 nt, Homo sapiens
ccgggggugggggguggggg

SEQ ID NO: 2559 - RNA, 20 nt, Homo sapiens
cggggguggggggugggggg

SEQ ID NO: 2560 - RNA, 20 nt, Homo sapiens
gggggugggggguggggggu

SEQ ID NO: 2561 - RNA, 20 nt, Homo sapiens
ggggugggggguggggggug

SEQ ID NO: 2562 - RNA, 20 nt, Homo sapiens
gggugggggguggggggugg

SEQ ID NO: 2563 - RNA, 20 nt, Homo sapiens
gguggggggugggggguggg

SEQ ID NO: 2564 - RNA, 20 nt, Homo sapiens
gugggggguggggggugggg

SEQ ID NO: 2565 - RNA, 20 nt, Homo sapiens
ugggggguggggggugggga

SEQ ID NO: 2566 - RNA, 20 nt, Homo sapiens
ggggggugggggguggggag

SEQ ID NO: 2567 - RNA, 20 nt, Homo sapiens
gggggugggggguggggagg

SEQ ID NO: 2568 - RNA, 20 nt, Homo sapiens
ggggugggggguggggaggg

SEQ ID NO: 2569 - RNA, 20 nt, Homo sapiens
gggugggggguggggagggg

SEQ ID NO: 2570 - RNA, 20 nt, Homo sapiens
ggugggggguggggaggggg

SEQ ID NO: 2571 - RNA, 20 nt, Homo sapiens
gugggggguggggagggggc

SEQ ID NO: 2572 - RNA, 20 nt, Homo sapiens
ugggggguggggagggggcg

SEQ ID NO: 2573 - RNA, 20 nt, Homo sapiens
gggggguggggagggggcgg

SEQ ID NO: 2574 - RNA, 20 nt, Homo sapiens
ggggguggggagggggcggu

SEQ ID NO: 2575 - RNA, 20 nt, Homo sapiens
gggguggggagggggcgguc

SEQ ID NO: 2576 - RNA, 20 nt, Homo sapiens
ggguggggagggggcgguca

SEQ ID NO: 2577 - RNA, 20 nt, Homo sapiens
gguggggagggggcggucag

SEQ ID NO: 2578 - RNA, 20 nt, Homo sapiens
guggggagggggcggucagg

SEQ ID NO: 2579 - RNA, 20 nt, Homo sapiens
uggggagggggcggucaggc

SEQ ID NO: 2580 - RNA, 20 nt, Homo sapiens
ggggagggggcggucaggcg

SEQ ID NO: 2581 - RNA, 20 nt, Homo sapiens
gggagggggcggucaggcgg

SEQ ID NO: 2582 - RNA, 20 nt, Homo sapiens
ggagggggcggucaggcggc

SEQ ID NO: 2583 - RNA, 20 nt, Homo sapiens
gagggggcggucaggcggcg

SEQ ID NO: 2584 - RNA, 20 nt, Homo sapiens
agggggcggucaggcggcgg

SEQ ID NO: 2585 - RNA, 20 nt, Homo sapiens
gggggcggucaggcggcggg

SEQ ID NO: 2586 - RNA, 20 nt, Homo sapiens
ggggcggucaggcggcgggg

SEQ ID NO: 2587 - RNA, 20 nt, Homo sapiens
gggcggucaggcggcggggu

SEQ ID NO: 2588 - RNA, 20 nt, Homo sapiens
ggcggucaggcggcggggug

SEQ ID NO: 2589 - RNA, 20 nt, Homo sapiens
gcggucaggcggcggggugg

SEQ ID NO: 2590 - RNA, 20 nt, Homo sapiens
cggucaggcggcgggguggg

SEQ ID NO: 2591 - RNA, 20 nt, Homo sapiens
ggucaggcggcggggugggc

SEQ ID NO: 2592 - RNA, 20 nt, Homo sapiens
gucaggcggcggggugggcu

SEQ ID NO: 2593 - RNA, 20 nt, Homo sapiens
ucaggcggcggggugggcug

SEQ ID NO: 2594 - RNA, 20 nt, Homo sapiens
caggcggcggggugggcugg

SEQ ID NO: 2595 - RNA, 20 nt, Homo sapiens
aggcggcggggugggcuggu

SEQ ID NO: 2596 - RNA, 20 nt, Homo sapiens
ggcggcggggugggcuggug

SEQ ID NO: 2597 - RNA, 20 nt, Homo sapiens
gcggcggggugggcuggugg

SEQ ID NO: 2598 - RNA, 20 nt, Homo sapiens
cggcggggugggcuggugga

SEQ ID NO: 2599 - RNA, 20 nt, Homo sapiens
ggcggggugggcugguggag

SEQ ID NO: 2600 - RNA, 20 nt, Homo sapiens
gcggggugggcugguggaga

SEQ ID NO: 2601 - RNA, 20 nt, Homo sapiens
cggggugggcugguggagag

SEQ ID NO: 2602 - RNA, 20 nt, Homo sapiens
ggggugggcugguggagagg

SEQ ID NO: 2603 - RNA, 20 nt, Homo sapiens
gggugggcugguggagaggc

SEQ ID NO: 2604 - RNA, 20 nt, Homo sapiens
ggugggcugguggagaggca

SEQ ID NO: 2605 - RNA, 20 nt, Homo sapiens
gugggcugguggagaggcag

SEQ ID NO: 2606 - RNA, 20 nt, Homo sapiens
ugggcugguggagaggcagg

SEQ ID NO: 2607 - RNA, 20 nt, Homo sapiens
gggcugguggagaggcagga

SEQ ID NO: 2608 - RNA, 20 nt, Homo sapiens
ggcugguggagaggcaggag

SEQ ID NO: 2609 - RNA, 20 nt, Homo sapiens
gcugguggagaggcaggaga

SEQ ID NO: 2610 - RNA, 20 nt, Homo sapiens
cugguggagaggcaggagag

SEQ ID NO: 2611 - RNA, 20 nt, Homo sapiens
ugguggagaggcaggagagc

SEQ ID NO: 2612 - RNA, 20 nt, Homo sapiens
gguggagaggcaggagagcu

SEQ ID NO: 2613 - RNA, 20 nt, Homo sapiens
guggagaggcaggagagcuc

SEQ ID NO: 2614 - RNA, 20 nt, Homo sapiens
uggagaggcaggagagcucu

SEQ ID NO: 2615 - RNA, 20 nt, Homo sapiens
ggagaggcaggagagcucug

SEQ ID NO: 2616 - RNA, 20 nt, Homo sapiens
gagaggcaggagagcucugc

SEQ ID NO: 2617 - RNA, 20 nt, Homo sapiens
agaggcaggagagcucugcc

SEQ ID NO: 2618 - RNA, 20 nt, Homo sapiens
gaggcaggagagcucugccc

SEQ ID NO: 2619 - RNA, 20 nt, Homo sapiens
aggcaggagagcucugcccg

SEQ ID NO: 2620 - RNA, 20 nt, Homo sapiens
ggcaggagagcucugcccgg

SEQ ID NO: 2621 - RNA, 20 nt, Homo sapiens
gcaggagagcucugcccggg

SEQ ID NO: 2622 - RNA, 20 nt, Homo sapiens
caggagagcucugcccgggc

SEQ ID NO: 2623 - RNA, 20 nt, Homo sapiens
aggagagcucugcccgggcu

SEQ ID NO: 2624 - RNA, 20 nt, Homo sapiens
ggagagcucugcccgggcug

SEQ ID NO: 2625 - RNA, 20 nt, Homo sapiens
gagagcucugcccgggcugc

SEQ ID NO: 2626 - RNA, 20 nt, Homo sapiens
agagcucugcccgggcugcu

SEQ ID NO: 2627 - RNA, 20 nt, Homo sapiens
gagcucugcccgggcugcuc

SEQ ID NO: 2628 - RNA, 20 nt, Homo sapiens
agcucugcccgggcugcucc

SEQ ID NO: 2629 - RNA, 20 nt, Homo sapiens
gcucugcccgggcugcuccc

SEQ ID NO: 2630 - RNA, 20 nt, Homo sapiens
cucugcccgggcugcuccca

SEQ ID NO: 2631 - RNA, 20 nt, Homo sapiens
ucugcccgggcugcucccac

SEQ ID NO: 2632 - RNA, 20 nt, Homo sapiens
cugcccgggcugcucccaca

SEQ ID NO: 2633 - RNA, 20 nt, Homo sapiens
ugcccgggcugcucccacag

SEQ ID NO: 2634 - RNA, 20 nt, Homo sapiens
gcccgggcugcucccacagc

SEQ ID NO: 2635 - RNA, 20 nt, Homo sapiens
cccgggcugcucccacagcc

SEQ ID NO: 2636 - RNA, 20 nt, Homo sapiens
ccgggcugcucccacagccc

SEQ ID NO: 2637 - RNA, 20 nt, Homo sapiens
cgggcugcucccacagccca

SEQ ID NO: 2638 - RNA, 20 nt, Homo sapiens
gggcugcucccacagcccag

SEQ ID NO: 2639 - RNA, 20 nt, Homo sapiens
ggcugcucccacagcccagg

SEQ ID NO: 2640 - RNA, 20 nt, Homo sapiens
gcugcucccacagcccaggc

SEQ ID NO: 2641 - RNA, 20 nt, Homo sapiens
cugcucccacagcccaggcg

SEQ ID NO: 2642 - RNA, 20 nt, Homo sapiens
ugcucccacagcccaggcgg

SEQ ID NO: 2643 - RNA, 20 nt, Homo sapiens
gcucccacagcccaggcggc

SEQ ID NO: 2644 - RNA, 20 nt, Homo sapiens
cucccacagcccaggcggcu

SEQ ID NO: 2645 - RNA, 20 nt, Homo sapiens
ucccacagcccaggcggcug

SEQ ID NO: 2646 - RNA, 20 nt, Homo sapiens
cccacagcccaggcggcugc

SEQ ID NO: 2647 - RNA, 20 nt, Homo sapiens
ccacagcccaggcggcugcc

SEQ ID NO: 2648 - RNA, 20 nt, Homo sapiens
cacagcccaggcggcugccc

SEQ ID NO: 2649 - RNA, 20 nt, Homo sapiens
acagcccaggcggcugcccg

SEQ ID NO: 2650 - RNA, 20 nt, Homo sapiens
cagcccaggcggcugcccgc

SEQ ID NO: 2651 - RNA, 20 nt, Homo sapiens
agcccaggcggcugcccgca

SEQ ID NO: 2652 - RNA, 20 nt, Homo sapiens
gcccaggcggcugcccgcaa

SEQ ID NO: 2653 - RNA, 20 nt, Homo sapiens
cccaggcggcugcccgcaaa

SEQ ID NO: 2654 - RNA, 20 nt, Homo sapiens
ccaggcggcugcccgcaaac

SEQ ID NO: 2655 - RNA, 20 nt, Homo sapiens
caggcggcugcccgcaaacc

SEQ ID NO: 2656 - RNA, 20 nt, Homo sapiens
aggcggcugcccgcaaaccc

SEQ ID NO: 2657 - RNA, 20 nt, Homo sapiens
ggcggcugcccgcaaacccg

SEQ ID NO: 2658 - RNA, 20 nt, Homo sapiens
gcggcugcccgcaaacccgc

SEQ ID NO: 2659 - RNA, 20 nt, Homo sapiens
cggcugcccgcaaacccgcg

SEQ ID NO: 2660 - RNA, 20 nt, Homo sapiens
ggcugcccgcaaacccgcgc

SEQ ID NO: 2661 - RNA, 20 nt, Homo sapiens
gcugcccgcaaacccgcgcg

SEQ ID NO: 2662 - RNA, 20 nt, Homo sapiens
cugcccgcaaacccgcgcgu

SEQ ID NO: 2663 - RNA, 20 nt, Homo sapiens
ugcccgcaaacccgcgcgug

SEQ ID NO: 2664 - RNA, 20 nt, Homo sapiens
gcccgcaaacccgcgcgugc

SEQ ID NO: 2665 - RNA, 20 nt, Homo sapiens
cccgcaaacccgcgcgugcg

SEQ ID NO: 2666 - RNA, 20 nt, Homo sapiens
ccgcaaacccgcgcgugcgc

SEQ ID NO: 2667 - RNA, 20 nt, Homo sapiens
cgcaaacccgcgcgugcgca

SEQ ID NO: 2668 - RNA, 20 nt, Homo sapiens
gcaaacccgcgcgugcgcag

SEQ ID NO: 2669 - RNA, 20 nt, Homo sapiens
caaacccgcgcgugcgcagu

SEQ ID NO: 2670 - RNA, 20 nt, Homo sapiens
aaacccgcgcgugcgcagua

SEQ ID NO: 2671 - RNA, 20 nt, Homo sapiens
aacccgcgcgugcgcaguag

SEQ ID NO: 2672 - RNA, 20 nt, Homo sapiens
acccgcgcgugcgcaguagg

SEQ ID NO: 2673 - RNA, 20 nt, Homo sapiens
cccgcgcgugcgcaguaggc

SEQ ID NO: 2674 - RNA, 20 nt, Homo sapiens
ccgcgcgugcgcaguaggcg

SEQ ID NO: 2675 - RNA, 20 nt, Homo sapiens
cgcgcgugcgcaguaggcgg

SEQ ID NO: 2676 - RNA, 20 nt, Homo sapiens
gcgcgugcgcaguaggcggc

SEQ ID NO: 2677 - RNA, 20 nt, Homo sapiens
cgcgugcgcaguaggcggcc

SEQ ID NO: 2678 - RNA, 20 nt, Homo sapiens
gcgugcgcaguaggcggccc

SEQ ID NO: 2679 - RNA, 20 nt, Homo sapiens
cgugcgcaguaggcggccca

SEQ ID NO: 2680 - RNA, 20 nt, Homo sapiens
gugcgcaguaggcggcccac

SEQ ID NO: 2681 - RNA, 20 nt, Homo sapiens
ugcgcaguaggcggcccacc

SEQ ID NO: 2682 - RNA, 20 nt, Homo sapiens
gcgcaguaggcggcccaccu

SEQ ID NO: 2683 - RNA, 20 nt, Homo sapiens
cgcaguaggcggcccaccug

SEQ ID NO: 2684 - RNA, 20 nt, Homo sapiens
gcaguaggcggcccaccugc

SEQ ID NO: 2685 - RNA, 20 nt, Homo sapiens
caguaggcggcccaccugcu

SEQ ID NO: 2686 - RNA, 20 nt, Homo sapiens
aguaggcggcccaccugcug

SEQ ID NO: 2687 - RNA, 20 nt, Homo sapiens
guaggcggcccaccugcugg

SEQ ID NO: 2688 - RNA, 20 nt, Homo sapiens
uaggcggcccaccugcuggu

SEQ ID NO: 2689 - RNA, 20 nt, Homo sapiens
aggcggcccaccugcuggua

SEQ ID NO: 2690 - RNA, 20 nt, Homo sapiens
ggcggcccaccugcugguac

SEQ ID NO: 2691 - RNA, 20 nt, Homo sapiens
gcggcccaccugcugguacc

SEQ ID NO: 2692 - RNA, 20 nt, Homo sapiens
cggcccaccugcugguaccu

SEQ ID NO: 2693 - RNA, 20 nt, Homo sapiens
ggcccaccugcugguaccug

SEQ ID NO: 2694 - RNA, 20 nt, Homo sapiens
gcccaccugcugguaccugg

SEQ ID NO: 2695 - RNA, 20 nt, Homo sapiens
cccaccugcugguaccuggg

SEQ ID NO: 2696 - RNA, 20 nt, Homo sapiens
ccaccugcugguaccugggc

SEQ ID NO: 2697 - RNA, 20 nt, Homo sapiens
caccugcugguaccugggcc

SEQ ID NO: 2698 - RNA, 20 nt, Homo sapiens
accugcugguaccugggccg

SEQ ID NO: 2699 - RNA, 20 nt, Homo sapiens
ccugcugguaccugggccgg

SEQ ID NO: 2700 - RNA, 20 nt, Homo sapiens
cugcugguaccugggccggc

SEQ ID NO: 2701 - RNA, 20 nt, Homo sapiens
ugcugguaccugggccggcu

SEQ ID NO: 2702 - RNA, 20 nt, Homo sapiens
gcugguaccugggccggcuc

SEQ ID NO: 2703 - RNA, 20 nt, Homo sapiens
cugguaccugggccggcucu

SEQ ID NO: 2704 - RNA, 20 nt, Homo sapiens
ugguaccugggccggcucug

SEQ ID NO: 2705 - RNA, 20 nt, Homo sapiens
gguaccugggccggcucugg

SEQ ID NO: 2706 - RNA, 20 nt, Homo sapiens
guaccugggccggcucuggg

SEQ ID NO: 2707 - RNA, 20 nt, Homo sapiens
uaccugggccggcucuggga

SEQ ID NO: 2708 - RNA, 20 nt, Homo sapiens
accugggccggcucugggau

SEQ ID NO: 2709 - RNA, 20 nt, Homo sapiens
ccugggccggcucugggauc

SEQ ID NO: 2710 - RNA, 20 nt, Homo sapiens
cugggccggcucugggaucc

SEQ ID NO: 2711 - RNA, 20 nt, Homo sapiens
ugggccggcucugggauccc

SEQ ID NO: 2712 - RNA, 20 nt, Homo sapiens
gggccggcucugggaucccc

SEQ ID NO: 2713 - RNA, 20 nt, Homo sapiens
ggccggcucugggauccccg

SEQ ID NO: 2714 - RNA, 20 nt, Homo sapiens
gccggcucugggauccccgg

SEQ ID NO: 2715 - RNA, 20 nt, Homo sapiens
ccggcucugggauccccggg

SEQ ID NO: 2716 - RNA, 20 nt, Homo sapiens
cggcucugggauccccggga

SEQ ID NO: 2717 - RNA, 20 nt, Homo sapiens
ggcucugggauccccgggau

SEQ ID NO: 2718 - RNA, 20 nt, Homo sapiens
gcucugggauccccgggaug

SEQ ID NO: 2719 - RNA, 20 nt, Homo sapiens
cucugggauccccgggaugc

SEQ ID NO: 2720 - RNA, 20 nt, Homo sapiens
ucugggauccccgggaugcc

SEQ ID NO: 2721 - RNA, 20 nt, Homo sapiens
cugggauccccgggaugccc

SEQ ID NO: 2722 - RNA, 20 nt, Homo sapiens
ugggauccccgggaugccca

SEQ ID NO: 2723 - RNA, 20 nt, Homo sapiens
gggauccccgggaugcccag

SEQ ID NO: 2724 - RNA, 20 nt, Homo sapiens
ggauccccgggaugcccagg

SEQ ID NO: 2725 - RNA, 20 nt, Homo sapiens
gauccccgggaugcccagga

SEQ ID NO: 2726 - RNA, 20 nt, Homo sapiens
auccccgggaugcccaggaa

SEQ ID NO: 2727 - RNA, 20 nt, Homo sapiens
uccccgggaugcccaggaaa

SEQ ID NO: 2728 - RNA, 20 nt, Homo sapiens
ccccgggaugcccaggaaag

SEQ ID NO: 2729 - RNA, 20 nt, Homo sapiens
cccgggaugcccaggaaaga

SEQ ID NO: 2730 - RNA, 20 nt, Homo sapiens
ccgggaugcccaggaaagaa

SEQ ID NO: 2731 - RNA, 20 nt, Homo sapiens
cgggaugcccaggaaagaau

SEQ ID NO: 2732 - RNA, 20 nt, Homo sapiens
gggaugcccaggaaagaaug

SEQ ID NO: 2733 - RNA, 20 nt, Homo sapiens
ggaugcccaggaaagaaugg

SEQ ID NO: 2734 - RNA, 20 nt, Homo sapiens
gaugcccaggaaagaauggc

SEQ ID NO: 2735 - RNA, 20 nt, Homo sapiens
augcccaggaaagaauggca

SEQ ID NO: 2736 - RNA, 20 nt, Homo sapiens
ugcccaggaaagaauggcag

SEQ ID NO: 2737 - RNA, 20 nt, Homo sapiens
gcccaggaaagaauggcagu

SEQ ID NO: 2738 - RNA, 20 nt, Homo sapiens
cccaggaaagaauggcaguu

SEQ ID NO: 2739 - RNA, 20 nt, Homo sapiens
ccaggaaagaauggcaguuc

SEQ ID NO: 2740 - RNA, 20 nt, Homo sapiens
caggaaagaauggcaguucu

SEQ ID NO: 2741 - RNA, 20 nt, Homo sapiens
aggaaagaauggcaguucuc

SEQ ID NO: 2742 - RNA, 20 nt, Homo sapiens
ggaaagaauggcaguucucc

SEQ ID NO: 2743 - RNA, 20 nt, Homo sapiens
gaaagaauggcaguucuccg

SEQ ID NO: 2744 - RNA, 20 nt, Homo sapiens
aaagaauggcaguucuccgc

SEQ ID NO: 2745 - RNA, 20 nt, Homo sapiens
aagaauggcaguucuccgcg

SEQ ID NO: 2746 - RNA, 20 nt, Homo sapiens
agaauggcaguucuccgcgg

SEQ ID NO: 2747 - RNA, 20 nt, Homo sapiens
gaauggcaguucuccgcggu

SEQ ID NO: 2748 - RNA, 20 nt, Homo sapiens
aauggcaguucuccgcggug

SEQ ID NO: 2749 - RNA, 20 nt, Homo sapiens
auggcaguucuccgcggugu

SEQ ID NO: 2750 - RNA, 20 nt, Homo sapiens
uggcaguucuccgcggugug

SEQ ID NO: 2751 - RNA, 20 nt, Homo sapiens
ggcaguucuccgcggugugg

SEQ ID NO: 2752 - RNA, 20 nt, Homo sapiens
gcaguucuccgcggugugga

SEQ ID NO: 2753 - RNA, 20 nt, Homo sapiens
caguucuccgcgguguggag

SEQ ID NO: 2754 - RNA, 20 nt, Homo sapiens
aguucuccgcgguguggagu

SEQ ID NO: 2755 - RNA, 20 nt, Homo sapiens
guucuccgcgguguggaguc

SEQ ID NO: 2756 - RNA, 20 nt, Homo sapiens
uucuccgcgguguggagucu

SEQ ID NO: 2757 - RNA, 20 nt, Homo sapiens
ucuccgcgguguggagucuc

SEQ ID NO: 2758 - RNA, 20 nt, Homo sapiens
cuccgcgguguggagucucu

SEQ ID NO: 2759 - RNA, 20 nt, Homo sapiens
uccgcgguguggagucucuc

SEQ ID NO: 2760 - RNA, 20 nt, Homo sapiens
ccgcgguguggagucucuca

SEQ ID NO: 2761 - RNA, 20 nt, Homo sapiens
cgcgguguggagucucucac

SEQ ID NO: 2762 - RNA, 20 nt, Homo sapiens
gcgguguggagucucucacc

SEQ ID NO: 2763 - RNA, 20 nt, Homo sapiens
cgguguggagucucucaccg

SEQ ID NO: 2764 - RNA, 20 nt, Homo sapiens
gguguggagucucucaccgg

SEQ ID NO: 2765 - RNA, 20 nt, Homo sapiens
guguggagucucucaccggg

SEQ ID NO: 2766 - RNA, 20 nt, Homo sapiens
uguggagucucucaccgggc

SEQ ID NO: 2767 - RNA, 20 nt, Homo sapiens
guggagucucucaccgggcc

SEQ ID NO: 2768 - RNA, 20 nt, Homo sapiens
uggagucucucaccgggccu

SEQ ID NO: 2769 - RNA, 20 nt, Homo sapiens
ggagucucucaccgggccua

SEQ ID NO: 2770 - RNA, 20 nt, Homo sapiens
gagucucucaccgggccuag

SEQ ID NO: 2771 - RNA, 20 nt, Homo sapiens
agucucucaccgggccuaga

SEQ ID NO: 2772 - RNA, 20 nt, Homo sapiens
gucucucaccgggccuagac

SEQ ID NO: 2773 - RNA, 20 nt, Homo sapiens
ucucucaccgggccuagacc

SEQ ID NO: 2774 - RNA, 20 nt, Homo sapiens
cucucaccgggccuagaccu

SEQ ID NO: 2775 - RNA, 20 nt, Homo sapiens
ucucaccgggccuagaccua

SEQ ID NO: 2776 - RNA, 20 nt, Homo sapiens
cucaccgggccuagaccuag

SEQ ID NO: 2777 - RNA, 20 nt, Homo sapiens
ucaccgggccuagaccuaga

SEQ ID NO: 2778 - RNA, 20 nt, Homo sapiens
caccgggccuagaccuagaa

SEQ ID NO: 2779 - RNA, 20 nt, Homo sapiens
accgggccuagaccuagaag

SEQ ID NO: 2780 - RNA, 20 nt, Homo sapiens
ccgggccuagaccuagaagg

SEQ ID NO: 2781 - RNA, 20 nt, Homo sapiens
cgggccuagaccuagaaggc

SEQ ID NO: 2782 - RNA, 20 nt, Homo sapiens
gggccuagaccuagaaggca

SEQ ID NO: 2783 - RNA, 20 nt, Homo sapiens
ggccuagaccuagaaggcag

SEQ ID NO: 2784 - RNA, 20 nt, Homo sapiens
gccuagaccuagaaggcagg

SEQ ID NO: 2785 - RNA, 20 nt, Homo sapiens
ccuagaccuagaaggcagga

SEQ ID NO: 2786 - RNA, 20 nt, Homo sapiens
cuagaccuagaaggcaggaa

SEQ ID NO: 2787 - RNA, 20 nt, Homo sapiens
uagaccuagaaggcaggaau

SEQ ID NO: 2788 - RNA, 20 nt, Homo sapiens
agaccuagaaggcaggaauc

SEQ ID NO: 2789 - RNA, 20 nt, Homo sapiens
gaccuagaaggcaggaaucc

SEQ ID NO: 2790 - RNA, 20 nt, Homo sapiens
accuagaaggcaggaauccc

SEQ ID NO: 2791 - RNA, 20 nt, Homo sapiens
ccuagaaggcaggaauccca

SEQ ID NO: 2792 - RNA, 20 nt, Homo sapiens
cuagaaggcaggaaucccag

SEQ ID NO: 2793 - RNA, 20 nt, Homo sapiens
uagaaggcaggaaucccagg

SEQ ID NO: 2794 - RNA, 20 nt, Homo sapiens
agaaggcaggaaucccaggc

SEQ ID NO: 2795 - RNA, 20 nt, Homo sapiens
gaaggcaggaaucccaggcc

SEQ ID NO: 2796 - RNA, 20 nt, Homo sapiens
aaggcaggaaucccaggccg

SEQ ID NO: 2797 - RNA, 20 nt, Homo sapiens
aggcaggaaucccaggccgg

SEQ ID NO: 2798 - RNA, 20 nt, Homo sapiens
ggcaggaaucccaggccggu

SEQ ID NO: 2799 - RNA, 20 nt, Homo sapiens
gcaggaaucccaggccgguc

SEQ ID NO: 2800 - RNA, 20 nt, Homo sapiens
caggaaucccaggccgguca

SEQ ID NO: 2801 - RNA, 20 nt, Homo sapiens
aggaaucccaggccggucag

SEQ ID NO: 2802 - RNA, 20 nt, Homo sapiens
ggaaucccaggccggucagc

SEQ ID NO: 2803 - RNA, 20 nt, Homo sapiens
gaaucccaggccggucagcc

SEQ ID NO: 2804 - RNA, 20 nt, Homo sapiens
aaucccaggccggucagccc

SEQ ID NO: 2805 - RNA, 20 nt, Homo sapiens
aucccaggccggucagcccg

SEQ ID NO: 2806 - RNA, 20 nt, Homo sapiens
ucccaggccggucagcccgg

SEQ ID NO: 2807 - RNA, 20 nt, Homo sapiens
cccaggccggucagcccggu

SEQ ID NO: 2808 - RNA, 20 nt, Homo sapiens
ccaggccggucagcccggug

SEQ ID NO: 2809 - RNA, 20 nt, Homo sapiens
caggccggucagcccggugg

SEQ ID NO: 2810 - RNA, 20 nt, Homo sapiens
aggccggucagcccggugga

SEQ ID NO: 2811 - RNA, 20 nt, Homo sapiens
ggccggucagcccgguggag

SEQ ID NO: 2812 - RNA, 20 nt, Homo sapiens
gccggucagcccgguggagg

SEQ ID NO: 2813 - RNA, 20 nt, Homo sapiens
ccggucagcccgguggaggg

SEQ ID NO: 2814 - RNA, 20 nt, Homo sapiens
cggucagcccgguggagggg

SEQ ID NO: 2815 - RNA, 20 nt, Homo sapiens
ggucagcccgguggaggggg

SEQ ID NO: 2816 - RNA, 20 nt, Homo sapiens
gucagcccgguggagggggc

SEQ ID NO: 2817 - RNA, 20 nt, Homo sapiens
ucagcccgguggagggggcg

SEQ ID NO: 2818 - RNA, 20 nt, Homo sapiens
cagcccgguggagggggcgg

SEQ ID NO: 2819 - RNA, 20 nt, Homo sapiens
agcccgguggagggggcggg

SEQ ID NO: 2820 - RNA, 20 nt, Homo sapiens
gcccgguggagggggcgggg

SEQ ID NO: 2821 - RNA, 20 nt, Homo sapiens
cccgguggagggggcggggc

SEQ ID NO: 2822 - RNA, 20 nt, Homo sapiens
ccgguggagggggcggggcg

SEQ ID NO: 2823 - RNA, 20 nt, Homo sapiens
cgguggagggggcggggcgg

SEQ ID NO: 2824 - RNA, 20 nt, Homo sapiens
gguggagggggcggggcgga

SEQ ID NO: 2825 - RNA, 20 nt, Homo sapiens
guggagggggcggggcggag

SEQ ID NO: 2826 - RNA, 20 nt, Homo sapiens
uggagggggcggggcggaga

SEQ ID NO: 2827 - RNA, 20 nt, Homo sapiens
ggagggggcggggcggagac

SEQ ID NO: 2828 - RNA, 20 nt, Homo sapiens
gagggggcggggcggagaca

SEQ ID NO: 2829 - RNA, 20 nt, Homo sapiens
agggggcggggcggagacac

SEQ ID NO: 2830 - RNA, 20 nt, Homo sapiens
gggggcggggcggagacacg

SEQ ID NO: 2831 - RNA, 20 nt, Homo sapiens
ggggcggggcggagacacgc

SEQ ID NO: 2832 - RNA, 20 nt, Homo sapiens
gggcggggcggagacacgcc

SEQ ID NO: 2833 - RNA, 20 nt, Homo sapiens
ggcggggcggagacacgccc

SEQ ID NO: 2834 - RNA, 20 nt, Homo sapiens
gcggggcggagacacgcccc

SEQ ID NO: 2835 - RNA, 20 nt, Homo sapiens
cggggcggagacacgccccu

SEQ ID NO: 2836 - RNA, 20 nt, Homo sapiens
ggggcggagacacgccccuc

SEQ ID NO: 2837 - RNA, 20 nt, Homo sapiens
gggcggagacacgccccucc

SEQ ID NO: 2838 - RNA, 20 nt, Homo sapiens
ggcggagacacgccccuccg

SEQ ID NO: 2839 - RNA, 20 nt, Homo sapiens
gcggagacacgccccuccgu

SEQ ID NO: 2840 - RNA, 20 nt, Homo sapiens
cggagacacgccccuccgua

SEQ ID NO: 2841 - RNA, 20 nt, Homo sapiens
ggagacacgccccuccguag

SEQ ID NO: 2842 - RNA, 20 nt, Homo sapiens
gagacacgccccuccguagc

SEQ ID NO: 2843 - RNA, 20 nt, Homo sapiens
agacacgccccuccguagcc

SEQ ID NO: 2844 - RNA, 20 nt, Homo sapiens
gacacgccccuccguagcca

SEQ ID NO: 2845 - RNA, 20 nt, Homo sapiens
acacgccccuccguagccag

SEQ ID NO: 2846 - RNA, 20 nt, Homo sapiens
cacgccccuccguagccagc

SEQ ID NO: 2847 - RNA, 20 nt, Homo sapiens
acgccccuccguagccagcc

SEQ ID NO: 2848 - RNA, 20 nt, Homo sapiens
cgccccuccguagccagcca

SEQ ID NO: 2849 - RNA, 20 nt, Homo sapiens
gccccuccguagccagccag

SEQ ID NO: 2850 - RNA, 20 nt, Homo sapiens
ccccuccguagccagccagg

SEQ ID NO: 2851 - RNA, 20 nt, Homo sapiens
cccuccguagccagccaggu

SEQ ID NO: 2852 - RNA, 20 nt, Homo sapiens
ccuccguagccagccaggug

SEQ ID NO: 2853 - RNA, 20 nt, Homo sapiens
cuccguagccagccaggugu

SEQ ID NO: 2854 - RNA, 20 nt, Homo sapiens
uccguagccagccagguguu

SEQ ID NO: 2855 - RNA, 20 nt, Homo sapiens
ccguagccagccagguguuc

SEQ ID NO: 2856 - RNA, 20 nt, Homo sapiens
cguagccagccagguguucc

SEQ ID NO: 2857 - RNA, 20 nt, Homo sapiens
guagccagccagguguuccc

SEQ ID NO: 2858 - RNA, 20 nt, Homo sapiens
uagccagccagguguucccc

SEQ ID NO: 2859 - RNA, 20 nt, Homo sapiens
agccagccagguguuccccg

SEQ ID NO: 2860 - RNA, 20 nt, Homo sapiens
gccagccagguguuccccgc

SEQ ID NO: 2861 - RNA, 20 nt, Homo sapiens
ccagccagguguuccccgcg

SEQ ID NO: 2862 - RNA, 20 nt, Homo sapiens
cagccagguguuccccgcga

SEQ ID NO: 2863 - RNA, 20 nt, Homo sapiens
agccagguguuccccgcgaa

SEQ ID NO: 2864 - RNA, 20 nt, Homo sapiens
gccagguguuccccgcgaaa

SEQ ID NO: 2865 - RNA, 20 nt, Homo sapiens
ccagguguuccccgcgaaag

SEQ ID NO: 2866 - RNA, 20 nt, Homo sapiens
cagguguuccccgcgaaaga

SEQ ID NO: 2867 - RNA, 20 nt, Homo sapiens
agguguuccccgcgaaagag

SEQ ID NO: 2868 - RNA, 20 nt, Homo sapiens
gguguuccccgcgaaagaga

SEQ ID NO: 2869 - RNA, 20 nt, Homo sapiens
guguuccccgcgaaagagag

SEQ ID NO: 2870 - RNA, 20 nt, Homo sapiens
uguuccccgcgaaagagagg

SEQ ID NO: 2871 - RNA, 20 nt, Homo sapiens
guuccccgcgaaagagaggc

SEQ ID NO: 2872 - RNA, 20 nt, Homo sapiens
uuccccgcgaaagagaggcc

SEQ ID NO: 2873 - RNA, 20 nt, Homo sapiens
uccccgcgaaagagaggcca

SEQ ID NO: 2874 - RNA, 20 nt, Homo sapiens
ccccgcgaaagagaggccac

SEQ ID NO: 2875 - RNA, 20 nt, Homo sapiens
cccgcgaaagagaggccacg

SEQ ID NO: 2876 - RNA, 20 nt, Homo sapiens
ccgcgaaagagaggccacgg

SEQ ID NO: 2877 - RNA, 20 nt, Homo sapiens
cgcgaaagagaggccacggc

SEQ ID NO: 2878 - RNA, 20 nt, Homo sapiens
gcgaaagagaggccacggcc

SEQ ID NO: 2879 - RNA, 20 nt, Homo sapiens
cgaaagagaggccacggccc

SEQ ID NO: 2880 - RNA, 20 nt, Homo sapiens
gaaagagaggccacggcccu

SEQ ID NO: 2881 - RNA, 20 nt, Homo sapiens
aaagagaggccacggcccug

SEQ ID NO: 2882 - RNA, 20 nt, Homo sapiens
aagagaggccacggcccugc

SEQ ID NO: 2883 - RNA, 20 nt, Homo sapiens
agagaggccacggcccugcc

SEQ ID NO: 2884 - RNA, 20 nt, Homo sapiens
gagaggccacggcccugccc

SEQ ID NO: 2885 - RNA, 20 nt, Homo sapiens
agaggccacggcccugcccc

SEQ ID NO: 2886 - RNA, 20 nt, Homo sapiens
gaggccacggcccugccccg

SEQ ID NO: 2887 - RNA, 20 nt, Homo sapiens
aggccacggcccugccccga

SEQ ID NO: 2888 - RNA, 20 nt, Homo sapiens
ggccacggcccugccccgaa

SEQ ID NO: 2889 - RNA, 20 nt, Homo sapiens
gccacggcccugccccgaac

SEQ ID NO: 2890 - RNA, 20 nt, Homo sapiens
ccacggcccugccccgaacc

SEQ ID NO: 2891 - RNA, 20 nt, Homo sapiens
cacggcccugccccgaacca

SEQ ID NO: 2892 - RNA, 20 nt, Homo sapiens
acggcccugccccgaaccac

SEQ ID NO: 2893 - RNA, 20 nt, Homo sapiens
cggcccugccccgaaccacc

SEQ ID NO: 2894 - RNA, 20 nt, Homo sapiens
ggcccugccccgaaccaccc

SEQ ID NO: 2895 - RNA, 20 nt, Homo sapiens
gcccugccccgaaccacccg

SEQ ID NO: 2896 - RNA, 20 nt, Homo sapiens
cccugccccgaaccacccga

SEQ ID NO: 2897 - RNA, 20 nt, Homo sapiens
ccugccccgaaccacccgac

SEQ ID NO: 2898 - RNA, 20 nt, Homo sapiens
cugccccgaaccacccgacc

SEQ ID NO: 2899 - RNA, 20 nt, Homo sapiens
ugccccgaaccacccgaccc

SEQ ID NO: 2900 - RNA, 20 nt, Homo sapiens
gccccgaaccacccgacccc

SEQ ID NO: 2901 - RNA, 20 nt, Homo sapiens
ccccgaaccacccgaccccg

SEQ ID NO: 2902 - RNA, 20 nt, Homo sapiens
cccgaaccacccgaccccgu

SEQ ID NO: 2903 - RNA, 20 nt, Homo sapiens
ccgaaccacccgaccccguc

SEQ ID NO: 2904 - RNA, 20 nt, Homo sapiens
cgaaccacccgaccccgucc

SEQ ID NO: 2905 - RNA, 20 nt, Homo sapiens
gaaccacccgaccccguccc

SEQ ID NO: 2906 - RNA, 20 nt, Homo sapiens
aaccacccgaccccguccca

SEQ ID NO: 2907 - RNA, 20 nt, Homo sapiens
accacccgaccccgucccaa

SEQ ID NO: 2908 - RNA, 20 nt, Homo sapiens
ccacccgaccccgucccaac

SEQ ID NO: 2909 - RNA, 20 nt, Homo sapiens
cacccgaccccgucccaacc

SEQ ID NO: 2910 - RNA, 20 nt, Homo sapiens
acccgaccccgucccaaccc

SEQ ID NO: 2911 - RNA, 20 nt, Homo sapiens
cccgaccccgucccaacccc

SEQ ID NO: 2912 - RNA, 20 nt, Homo sapiens
ccgaccccgucccaaccccg

SEQ ID NO: 2913 - RNA, 20 nt, Homo sapiens
cgaccccgucccaaccccgc

SEQ ID NO: 2914 - RNA, 20 nt, Homo sapiens
gaccccgucccaaccccgcg

SEQ ID NO: 2915 - RNA, 20 nt, Homo sapiens
accccgucccaaccccgcgu

SEQ ID NO: 2916 - RNA, 20 nt, Homo sapiens
ccccgucccaaccccgcguc

SEQ ID NO: 2917 - RNA, 20 nt, Homo sapiens
cccgucccaaccccgcgucc

SEQ ID NO: 2918 - RNA, 20 nt, Homo sapiens
ccgucccaaccccgcguccu

SEQ ID NO: 2919 - RNA, 20 nt, Homo sapiens
cgucccaaccccgcguccua

SEQ ID NO: 2920 - RNA, 20 nt, Homo sapiens
gucccaaccccgcguccuaa

SEQ ID NO: 2921 - RNA, 20 nt, Homo sapiens
ucccaaccccgcguccuaaa

SEQ ID NO: 2922 - RNA, 20 nt, Homo sapiens
cccaaccccgcguccuaaag

SEQ ID NO: 2923 - RNA, 20 nt, Homo sapiens
ccaaccccgcguccuaaagc

SEQ ID NO: 2924 - RNA, 20 nt, Homo sapiens
caaccccgcguccuaaagcu

SEQ ID NO: 2925 - RNA, 20 nt, Homo sapiens
aaccccgcguccuaaagcuc

SEQ ID NO: 2926 - RNA, 20 nt, Homo sapiens
accccgcguccuaaagcucc

SEQ ID NO: 2927 - RNA, 20 nt, Homo sapiens
ccccgcguccuaaagcuccu

SEQ ID NO: 2928 - RNA, 20 nt, Homo sapiens
cccgcguccuaaagcuccuc

SEQ ID NO: 2929 - RNA, 20 nt, Homo sapiens
ccgcguccuaaagcuccucc

SEQ ID NO: 2930 - RNA, 20 nt, Homo sapiens
cgcguccuaaagcuccucca

SEQ ID NO: 2931 - RNA, 20 nt, Homo sapiens
gcguccuaaagcuccuccag

SEQ ID NO: 2932 - RNA, 20 nt, Homo sapiens
cguccuaaagcuccuccagc

SEQ ID NO: 2933 - RNA, 20 nt, Homo sapiens
guccuaaagcuccuccagca

SEQ ID NO: 2934 - RNA, 20 nt, Homo sapiens
uccuaaagcuccuccagcag

SEQ ID NO: 2935 - RNA, 20 nt, Homo sapiens
ccuaaagcuccuccagcaga

SEQ ID NO: 2936 - RNA, 20 nt, Homo sapiens
cuaaagcuccuccagcagag

SEQ ID NO: 2937 - RNA, 20 nt, Homo sapiens
uaaagcuccuccagcagagc

SEQ ID NO: 2938 - RNA, 20 nt, Homo sapiens
aaagcuccuccagcagagcc

SEQ ID NO: 2939 - RNA, 20 nt, Homo sapiens
aagcuccuccagcagagccc

SEQ ID NO: 2940 - RNA, 20 nt, Homo sapiens
agcuccuccagcagagcccg

SEQ ID NO: 2941 - RNA, 20 nt, Homo sapiens
gcuccuccagcagagcccgg

SEQ ID NO: 2942 - RNA, 20 nt, Homo sapiens
cuccuccagcagagcccggu

SEQ ID NO: 2943 - RNA, 20 nt, Homo sapiens
uccuccagcagagcccggua

SEQ ID NO: 2944 - RNA, 20 nt, Homo sapiens
ccuccagcagagcccgguau

SEQ ID NO: 2945 - RNA, 20 nt, Homo sapiens
cuccagcagagcccgguauu

SEQ ID NO: 2946 - RNA, 20 nt, Homo sapiens
uccagcagagcccgguauuc

SEQ ID NO: 2947 - RNA, 20 nt, Homo sapiens
ccagcagagcccgguauucu

SEQ ID NO: 2948 - RNA, 20 nt, Homo sapiens
cagcagagcccgguauucuu

SEQ ID NO: 2949 - RNA, 20 nt, Homo sapiens
agcagagcccgguauucuuc

SEQ ID NO: 2950 - RNA, 20 nt, Homo sapiens
gcagagcccgguauucuucc

SEQ ID NO: 2951 - RNA, 20 nt, Homo sapiens
cagagcccgguauucuuccu

SEQ ID NO: 2952 - RNA, 20 nt, Homo sapiens
agagcccgguauucuuccuc

SEQ ID NO: 2953 - RNA, 20 nt, Homo sapiens
gagcccgguauucuuccucg

SEQ ID NO: 2954 - RNA, 20 nt, Homo sapiens
agcccgguauucuuccucgc

SEQ ID NO: 2955 - RNA, 20 nt, Homo sapiens
gcccgguauucuuccucgcu

SEQ ID NO: 2956 - RNA, 20 nt, Homo sapiens
cccgguauucuuccucgcug

SEQ ID NO: 2957 - RNA, 20 nt, Homo sapiens
ccgguauucuuccucgcuga

SEQ ID NO: 2958 - RNA, 20 nt, Homo sapiens
cgguauucuuccucgcugag

SEQ ID NO: 2959 - RNA, 20 nt, Homo sapiens
gguauucuuccucgcugagg

SEQ ID NO: 2960 - RNA, 20 nt, Homo sapiens
guauucuuccucgcugaggg

SEQ ID NO: 2961 - RNA, 20 nt, Homo sapiens
uauucuuccucgcugagggg

SEQ ID NO: 2962 - RNA, 20 nt, Homo sapiens
auucuuccucgcugaggggu

SEQ ID NO: 2963 - RNA, 20 nt, Homo sapiens
uucuuccucgcugaggggug

SEQ ID NO: 2964 - RNA, 20 nt, Homo sapiens
ucuuccucgcugaggggugc

SEQ ID NO: 2965 - RNA, 20 nt, Homo sapiens
cuuccucgcugaggggugcu

SEQ ID NO: 2966 - RNA, 20 nt, Homo sapiens
uuccucgcugaggggugcuu

SEQ ID NO: 2967 - RNA, 20 nt, Homo sapiens
uccucgcugaggggugcuuc

SEQ ID NO: 2968 - RNA, 20 nt, Homo sapiens
ccucgcugaggggugcuucc

SEQ ID NO: 2969 - RNA, 20 nt, Homo sapiens
cucgcugaggggugcuucca

SEQ ID NO: 2970 - RNA, 20 nt, Homo sapiens
ucgcugaggggugcuuccag

SEQ ID NO: 2971 - RNA, 20 nt, Homo sapiens
cgcugaggggugcuuccagc

SEQ ID NO: 2972 - RNA, 20 nt, Homo sapiens
gcugaggggugcuuccagcg

SEQ ID NO: 2973 - RNA, 20 nt, Homo sapiens
cugaggggugcuuccagcga

SEQ ID NO: 2974 - RNA, 20 nt, Homo sapiens
ugaggggugcuuccagcgag

SEQ ID NO: 2975 - RNA, 20 nt, Homo sapiens
gaggggugcuuccagcgagg

SEQ ID NO: 2976 - RNA, 20 nt, Homo sapiens
aggggugcuuccagcgaggc

SEQ ID NO: 2977 - RNA, 20 nt, Homo sapiens
ggggugcuuccagcgaggcg

SEQ ID NO: 2978 - RNA, 20 nt, Homo sapiens
gggugcuuccagcgaggcgg

SEQ ID NO: 2979 - RNA, 20 nt, Homo sapiens
ggugcuuccagcgaggcggc

SEQ ID NO: 2980 - RNA, 20 nt, Homo sapiens
gugcuuccagcgaggcggcc

SEQ ID NO: 2981 - RNA, 20 nt, Homo sapiens
ugcuuccagcgaggcggccu

SEQ ID NO: 2982 - RNA, 20 nt, Homo sapiens
gcuuccagcgaggcggccuc

SEQ ID NO: 2983 - RNA, 20 nt, Homo sapiens
cuuccagcgaggcggccucu

SEQ ID NO: 2984 - RNA, 20 nt, Homo sapiens
uuccagcgaggcggccucuu

SEQ ID NO: 2985 - RNA, 20 nt, Homo sapiens
uccagcgaggcggccucuuc

SEQ ID NO: 2986 - RNA, 20 nt, Homo sapiens
ccagcgaggcggccucuucc

SEQ ID NO: 2987 - RNA, 20 nt, Homo sapiens
cagcgaggcggccucuuccg

SEQ ID NO: 2988 - RNA, 20 nt, Homo sapiens
agcgaggcggccucuuccga

SEQ ID NO: 2989 - RNA, 20 nt, Homo sapiens
gcgaggcggccucuuccgag

SEQ ID NO: 2990 - RNA, 20 nt, Homo sapiens
cgaggcggccucuuccgagg

SEQ ID NO: 2991 - RNA, 20 nt, Homo sapiens
gaggcggccucuuccgaggc

SEQ ID NO: 2992 - RNA, 20 nt, Homo sapiens
aggcggccucuuccgaggcc

SEQ ID NO: 2993 - RNA, 20 nt, Homo sapiens
ggcggccucuuccgaggccu

SEQ ID NO: 2994 - RNA, 20 nt, Homo sapiens
gcggccucuuccgaggccuc

SEQ ID NO: 2995 - RNA, 20 nt, Homo sapiens
cggccucuuccgaggccucc

SEQ ID NO: 2996 - RNA, 20 nt, Homo sapiens
ggccucuuccgaggccucca

SEQ ID NO: 2997 - RNA, 20 nt, Homo sapiens
gccucuuccgaggccuccag

SEQ ID NO: 2998 - RNA, 20 nt, Homo sapiens
ccucuuccgaggccuccagc

SEQ ID NO: 2999 - RNA, 20 nt, Homo sapiens
cucuuccgaggccuccagcu

SEQ ID NO: 3000 - RNA, 20 nt, Homo sapiens
ucuuccgaggccuccagcuc

SEQ ID NO: 3001 - RNA, 20 nt, Homo sapiens
cuuccgaggccuccagcucc

SEQ ID NO: 3002 - RNA, 20 nt, Homo sapiens
uuccgaggccuccagcuccc

SEQ ID NO: 3003 - RNA, 20 nt, Homo sapiens
uccgaggccuccagcucccc

SEQ ID NO: 3004 - RNA, 20 nt, Homo sapiens
ccgaggccuccagcuccccc

SEQ ID NO: 3005 - RNA, 20 nt, Homo sapiens
cgaggccuccagcucccccg

SEQ ID NO: 3006 - RNA, 20 nt, Homo sapiens
gaggccuccagcucccccgg

SEQ ID NO: 3007 - RNA, 20 nt, Homo sapiens
aggccuccagcucccccggg

SEQ ID NO: 3008 - RNA, 20 nt, Homo sapiens
ggccuccagcucccccgggg

SEQ ID NO: 3009 - RNA, 20 nt, Homo sapiens
gccuccagcucccccggggc

SEQ ID NO: 3010 - RNA, 20 nt, Homo sapiens
ccuccagcucccccggggcc

SEQ ID NO: 3011 - RNA, 20 nt, Homo sapiens
cuccagcucccccggggccu

SEQ ID NO: 3012 - RNA, 20 nt, Homo sapiens
uccagcucccccggggccuc

SEQ ID NO: 3013 - RNA, 20 nt, Homo sapiens
ccagcucccccggggccucc

SEQ ID NO: 3014 - RNA, 20 nt, Homo sapiens
cagcucccccggggccuccg

SEQ ID NO: 3015 - RNA, 20 nt, Homo sapiens
agcucccccggggccuccgu

SEQ ID NO: 3016 - RNA, 20 nt, Homo sapiens
gcucccccggggccuccguu

SEQ ID NO: 3017 - RNA, 20 nt, Homo sapiens
cucccccggggccuccguuu

SEQ ID NO: 3018 - RNA, 20 nt, Homo sapiens
ucccccggggccuccguuuc

SEQ ID NO: 3019 - RNA, 20 nt, Homo sapiens
cccccggggccuccguuucu

SEQ ID NO: 3020 - RNA, 20 nt, Homo sapiens
ccccggggccuccguuucua

SEQ ID NO: 3021 - RNA, 20 nt, Homo sapiens
cccggggccuccguuucuag

SEQ ID NO: 3022 - RNA, 20 nt, Homo sapiens
ccggggccuccguuucuagg

SEQ ID NO: 3023 - RNA, 20 nt, Homo sapiens
cggggccuccguuucuagga

SEQ ID NO: 3024 - RNA, 20 nt, Homo sapiens
ggggccuccguuucuaggag

SEQ ID NO: 3025 - RNA, 20 nt, Homo sapiens
gggccuccguuucuaggaga

SEQ ID NO: 3026 - RNA, 20 nt, Homo sapiens
ggccuccguuucuaggagag

SEQ ID NO: 3027 - RNA, 20 nt, Homo sapiens
gccuccguuucuaggagagg

SEQ ID NO: 3028 - RNA, 20 nt, Homo sapiens
ccuccguuucuaggagaggu

SEQ ID NO: 3029 - RNA, 20 nt, Homo sapiens
cuccguuucuaggagagguu

SEQ ID NO: 3030 - RNA, 20 nt, Homo sapiens
uccguuucuaggagagguug

SEQ ID NO: 3031 - RNA, 20 nt, Homo sapiens
ccguuucuaggagagguugc

SEQ ID NO: 3032 - RNA, 20 nt, Homo sapiens
cguuucuaggagagguugcg

SEQ ID NO: 3033 - RNA, 20 nt, Homo sapiens
guuucuaggagagguugcgc

SEQ ID NO: 3034 - RNA, 20 nt, Homo sapiens
uuucuaggagagguugcgcc

SEQ ID NO: 3035 - RNA, 20 nt, Homo sapiens
uucuaggagagguugcgccu

SEQ ID NO: 3036 - RNA, 20 nt, Homo sapiens
ucuaggagagguugcgccug

SEQ ID NO: 3037 - RNA, 20 nt, Homo sapiens
cuaggagagguugcgccugc

SEQ ID NO: 3038 - RNA, 20 nt, Homo sapiens
uaggagagguugcgccugcu

SEQ ID NO: 3039 - RNA, 20 nt, Homo sapiens
aggagagguugcgccugcug

SEQ ID NO: 3040 - RNA, 20 nt, Homo sapiens
ggagagguugcgccugcugc

SEQ ID NO: 3041 - RNA, 20 nt, Homo sapiens
gagagguugcgccugcugca

SEQ ID NO: 3042 - RNA, 20 nt, Homo sapiens
agagguugcgccugcugcag

SEQ ID NO: 3043 - RNA, 20 nt, Homo sapiens
gagguugcgccugcugcaga

SEQ ID NO: 3044 - RNA, 20 nt, Homo sapiens
agguugcgccugcugcagaa

SEQ ID NO: 3045 - RNA, 20 nt, Homo sapiens
gguugcgccugcugcagaaa

SEQ ID NO: 3046 - RNA, 20 nt, Homo sapiens
guugcgccugcugcagaaac

SEQ ID NO: 3047 - RNA, 20 nt, Homo sapiens
uugcgccugcugcagaaacu

SEQ ID NO: 3048 - RNA, 20 nt, Homo sapiens
ugcgccugcugcagaaacuc

SEQ ID NO: 3049 - RNA, 20 nt, Homo sapiens
gcgccugcugcagaaacucc

SEQ ID NO: 3050 - RNA, 20 nt, Homo sapiens
cgccugcugcagaaacuccg

SEQ ID NO: 3051 - RNA, 20 nt, Homo sapiens
gccugcugcagaaacuccgg

SEQ ID NO: 3052 - RNA, 20 nt, Homo sapiens
ccugcugcagaaacuccggg

SEQ ID NO: 3053 - RNA, 20 nt, Homo sapiens
cugcugcagaaacuccgggc

SEQ ID NO: 3054 - RNA, 20 nt, Homo sapiens
ugcugcagaaacuccgggcu

SEQ ID NO: 3055 - RNA, 20 nt, Homo sapiens
gcugcagaaacuccgggcuc

SEQ ID NO: 3056 - RNA, 20 nt, Homo sapiens
cugcagaaacuccgggcucg

SEQ ID NO: 3057 - RNA, 20 nt, Homo sapiens
ugcagaaacuccgggcucgc

SEQ ID NO: 3058 - RNA, 20 nt, Homo sapiens
gcagaaacuccgggcucgcc

SEQ ID NO: 3059 - RNA, 20 nt, Homo sapiens
cagaaacuccgggcucgcca

SEQ ID NO: 3060 - RNA, 20 nt, Homo sapiens
agaaacuccgggcucgccag

SEQ ID NO: 3061 - RNA, 20 nt, Homo sapiens
gaaacuccgggcucgccagg

SEQ ID NO: 3062 - RNA, 20 nt, Homo sapiens
aaacuccgggcucgccagga

SEQ ID NO: 3063 - RNA, 20 nt, Homo sapiens
aacuccgggcucgccaggag

SEQ ID NO: 3064 - RNA, 20 nt, Homo sapiens
acuccgggcucgccaggagc

SEQ ID NO: 3065 - RNA, 20 nt, Homo sapiens
cuccgggcucgccaggagcu

SEQ ID NO: 3066 - RNA, 20 nt, Homo sapiens
uccgggcucgccaggagcuc

SEQ ID NO: 3067 - RNA, 20 nt, Homo sapiens
ccgggcucgccaggagcuca

SEQ ID NO: 3068 - RNA, 20 nt, Homo sapiens
cgggcucgccaggagcucau

SEQ ID NO: 3069 - RNA, 20 nt, Homo sapiens
gggcucgccaggagcucauc

SEQ ID NO: 3070 - RNA, 20 nt, Homo sapiens
ggcucgccaggagcucaucc

SEQ ID NO: 3071 - RNA, 20 nt, Homo sapiens
gcucgccaggagcucaucca

SEQ ID NO: 3072 - RNA, 20 nt, Homo sapiens
cucgccaggagcucauccag

SEQ ID NO: 3073 - RNA, 20 nt, Homo sapiens
ucgccaggagcucauccagc

SEQ ID NO: 3074 - RNA, 20 nt, Homo sapiens
cgccaggagcucauccagca

SEQ ID NO: 3075 - RNA, 20 nt, Homo sapiens
gccaggagcucauccagcag

SEQ ID NO: 3076 - RNA, 20 nt, Homo sapiens
ccaggagcucauccagcagc

SEQ ID NO: 3077 - RNA, 20 nt, Homo sapiens
caggagcucauccagcagca

SEQ ID NO: 3078 - RNA, 20 nt, Homo sapiens
aggagcucauccagcagcag

SEQ ID NO: 3079 - RNA, 20 nt, Homo sapiens
ggagcucauccagcagcagg

SEQ ID NO: 3080 - RNA, 20 nt, Homo sapiens
gagcucauccagcagcaggc

SEQ ID NO: 3081 - RNA, 20 nt, Homo sapiens
agcucauccagcagcaggcc

SEQ ID NO: 3082 - RNA, 20 nt, Homo sapiens
gcucauccagcagcaggccg

SEQ ID NO: 3083 - RNA, 20 nt, Homo sapiens
cucauccagcagcaggccgc

SEQ ID NO: 3084 - RNA, 20 nt, Homo sapiens
ucauccagcagcaggccgca

SEQ ID NO: 3085 - RNA, 20 nt, Homo sapiens
cauccagcagcaggccgcag

SEQ ID NO: 3086 - RNA, 20 nt, Homo sapiens
auccagcagcaggccgcagg

SEQ ID NO: 3087 - RNA, 20 nt, Homo sapiens
uccagcagcaggccgcaggg

SEQ ID NO: 3088 - RNA, 20 nt, Homo sapiens
ccagcagcaggccgcagggg

SEQ ID NO: 3089 - RNA, 20 nt, Homo sapiens
cagcagcaggccgcagggga

SEQ ID NO: 3090 - RNA, 20 nt, Homo sapiens
agcagcaggccgcaggggag

SEQ ID NO: 3091 - RNA, 20 nt, Homo sapiens
gcagcaggccgcaggggagu

SEQ ID NO: 3092 - RNA, 20 nt, Homo sapiens
cagcaggccgcaggggagug

SEQ ID NO: 3093 - RNA, 20 nt, Homo sapiens
agcaggccgcaggggagugc

SEQ ID NO: 3094 - RNA, 20 nt, Homo sapiens
gcaggccgcaggggagugca

SEQ ID NO: 3095 - RNA, 20 nt, Homo sapiens
caggccgcaggggagugcag

SEQ ID NO: 3096 - RNA, 20 nt, Homo sapiens
aggccgcaggggagugcaga

SEQ ID NO: 3097 - RNA, 20 nt, Homo sapiens
ggccgcaggggagugcagac

SEQ ID NO: 3098 - RNA, 20 nt, Homo sapiens
gccgcaggggagugcagacc

SEQ ID NO: 3099 - RNA, 20 nt, Homo sapiens
ccgcaggggagugcagacca

SEQ ID NO: 3100 - RNA, 20 nt, Homo sapiens
cgcaggggagugcagaccag

SEQ ID NO: 3101 - RNA, 20 nt, Homo sapiens
gcaggggagugcagaccagg

SEQ ID NO: 3102 - RNA, 20 nt, Homo sapiens
caggggagugcagaccaggg

SEQ ID NO: 3103 - RNA, 20 nt, Homo sapiens
aggggagugcagaccagggc

SEQ ID NO: 3104 - RNA, 20 nt, Homo sapiens
ggggagugcagaccagggcg

SEQ ID NO: 3105 - RNA, 20 nt, Homo sapiens
gggagugcagaccagggcgc

SEQ ID NO: 3106 - RNA, 20 nt, Homo sapiens
ggagugcagaccagggcgcc

SEQ ID NO: 3107 - RNA, 20 nt, Homo sapiens
gagugcagaccagggcgccg

SEQ ID NO: 3108 - RNA, 20 nt, Homo sapiens
agugcagaccagggcgccgg

SEQ ID NO: 3109 - RNA, 20 nt, Homo sapiens
gugcagaccagggcgccggc

SEQ ID NO: 3110 - RNA, 20 nt, Homo sapiens
ugcagaccagggcgccggcu

SEQ ID NO: 3111 - RNA, 20 nt, Homo sapiens
gcagaccagggcgccggcuc

SEQ ID NO: 3112 - RNA, 20 nt, Homo sapiens
cagaccagggcgccggcucc

SEQ ID NO: 3113 - RNA, 20 nt, Homo sapiens
agaccagggcgccggcuccu

SEQ ID NO: 3114 - RNA, 20 nt, Homo sapiens
gaccagggcgccggcuccug

SEQ ID NO: 3115 - RNA, 20 nt, Homo sapiens
accagggcgccggcuccugg

SEQ ID NO: 3116 - RNA, 20 nt, Homo sapiens
ccagggcgccggcuccugga

SEQ ID NO: 3117 - RNA, 20 nt, Homo sapiens
cagggcgccggcuccuggag

SEQ ID NO: 3118 - RNA, 20 nt, Homo sapiens
agggcgccggcuccuggagc

SEQ ID NO: 3119 - RNA, 20 nt, Homo sapiens
gggcgccggcuccuggagcg

SEQ ID NO: 3120 - RNA, 20 nt, Homo sapiens
ggcgccggcuccuggagcgc

SEQ ID NO: 3121 - RNA, 20 nt, Homo sapiens
gcgccggcuccuggagcgcc

SEQ ID NO: 3122 - RNA, 20 nt, Homo sapiens
cgccggcuccuggagcgccu

SEQ ID NO: 3123 - RNA, 20 nt, Homo sapiens
gccggcuccuggagcgccug

SEQ ID NO: 3124 - RNA, 20 nt, Homo sapiens
ccggcuccuggagcgccugg

SEQ ID NO: 3125 - RNA, 20 nt, Homo sapiens
cggcuccuggagcgccuggg

SEQ ID NO: 3126 - RNA, 20 nt, Homo sapiens
ggcuccuggagcgccuggga

SEQ ID NO: 3127 - RNA, 20 nt, Homo sapiens
gcuccuggagcgccugggag

SEQ ID NO: 3128 - RNA, 20 nt, Homo sapiens
cuccuggagcgccugggagg

SEQ ID NO: 3129 - RNA, 20 nt, Homo sapiens
uccuggagcgccugggaggg

SEQ ID NO: 3130 - RNA, 20 nt, Homo sapiens
ccuggagcgccugggagggc

SEQ ID NO: 3131 - RNA, 20 nt, Homo sapiens
cuggagcgccugggagggcg

SEQ ID NO: 3132 - RNA, 20 nt, Homo sapiens
uggagcgccugggagggcgc

SEQ ID NO: 3133 - RNA, 20 nt, Homo sapiens
ggagcgccugggagggcgcc

SEQ ID NO: 3134 - RNA, 20 nt, Homo sapiens
gagcgccugggagggcgccg

SEQ ID NO: 3135 - RNA, 20 nt, Homo sapiens
agcgccugggagggcgccgg

SEQ ID NO: 3136 - RNA, 20 nt, Homo sapiens
gcgccugggagggcgccggg

SEQ ID NO: 3137 - RNA, 20 nt, Homo sapiens
cgccugggagggcgccggga

SEQ ID NO: 3138 - RNA, 20 nt, Homo sapiens
gccugggagggcgccgggau

SEQ ID NO: 3139 - RNA, 20 nt, Homo sapiens
ccugggagggcgccgggaug

SEQ ID NO: 3140 - RNA, 20 nt, Homo sapiens
cugggagggcgccgggaugc

SEQ ID NO: 3141 - RNA, 20 nt, Homo sapiens
ugggagggcgccgggaugcc

SEQ ID NO: 3142 - RNA, 20 nt, Homo sapiens
gggagggcgccgggaugccu

SEQ ID NO: 3143 - RNA, 20 nt, Homo sapiens
ggagggcgccgggaugccuu

SEQ ID NO: 3144 - RNA, 20 nt, Homo sapiens
gagggcgccgggaugccuug

SEQ ID NO: 3145 - RNA, 20 nt, Homo sapiens
agggcgccgggaugccuugc

SEQ ID NO: 3146 - RNA, 20 nt, Homo sapiens
gggcgccgggaugccuugca

SEQ ID NO: 3147 - RNA, 20 nt, Homo sapiens
ggcgccgggaugccuugcau

SEQ ID NO: 3148 - RNA, 20 nt, Homo sapiens
gcgccgggaugccuugcauc

SEQ ID NO: 3149 - RNA, 20 nt, Homo sapiens
cgccgggaugccuugcaucu

SEQ ID NO: 3150 - RNA, 20 nt, Homo sapiens
gccgggaugccuugcaucug

SEQ ID NO: 3151 - RNA, 20 nt, Homo sapiens
ccgggaugccuugcaucugc

SEQ ID NO: 3152 - RNA, 20 nt, Homo sapiens
cgggaugccuugcaucugcc

SEQ ID NO: 3153 - RNA, 20 nt, Homo sapiens
gggaugccuugcaucugccc

SEQ ID NO: 3154 - RNA, 20 nt, Homo sapiens
ggaugccuugcaucugcccc

SEQ ID NO: 3155 - RNA, 20 nt, Homo sapiens
gaugccuugcaucugccccu

SEQ ID NO: 3156 - RNA, 20 nt, Homo sapiens
augccuugcaucugccccug

SEQ ID NO: 3157 - RNA, 20 nt, Homo sapiens
ugccuugcaucugccccugc

SEQ ID NO: 3158 - RNA, 20 nt, Homo sapiens
gccuugcaucugccccugcc

SEQ ID NO: 3159 - RNA, 20 nt, Homo sapiens
ccuugcaucugccccugccg

SEQ ID NO: 3160 - RNA, 20 nt, Homo sapiens
cuugcaucugccccugccgc

SEQ ID NO: 3161 - RNA, 20 nt, Homo sapiens
uugcaucugccccugccgcg

SEQ ID NO: 3162 - RNA, 20 nt, Homo sapiens
ugcaucugccccugccgcgc

SEQ ID NO: 3163 - RNA, 20 nt, Homo sapiens
gcaucugccccugccgcgcg

SEQ ID NO: 3164 - RNA, 20 nt, Homo sapiens
caucugccccugccgcgcgg

SEQ ID NO: 3165 - RNA, 20 nt, Homo sapiens
aucugccccugccgcgcgga

SEQ ID NO: 3166 - RNA, 20 nt, Homo sapiens
ucugccccugccgcgcggag

SEQ ID NO: 3167 - RNA, 20 nt, Homo sapiens
cugccccugccgcgcggagg

SEQ ID NO: 3168 - RNA, 20 nt, Homo sapiens
ugccccugccgcgcggaggc

SEQ ID NO: 3169 - RNA, 20 nt, Homo sapiens
gccccugccgcgcggaggcg

SEQ ID NO: 3170 - RNA, 20 nt, Homo sapiens
ccccugccgcgcggaggcgg

SEQ ID NO: 3171 - RNA, 20 nt, Homo sapiens
cccugccgcgcggaggcgga

SEQ ID NO: 3172 - RNA, 20 nt, Homo sapiens
ccugccgcgcggaggcggag

SEQ ID NO: 3173 - RNA, 20 nt, Homo sapiens
cugccgcgcggaggcggagg

SEQ ID NO: 3174 - RNA, 20 nt, Homo sapiens
ugccgcgcggaggcggaggc

SEQ ID NO: 3175 - RNA, 20 nt, Homo sapiens
gccgcgcggaggcggaggcg

SEQ ID NO: 3176 - RNA, 20 nt, Homo sapiens
ccgcgcggaggcggaggcgu

SEQ ID NO: 3177 - RNA, 20 nt, Homo sapiens
cgcgcggaggcggaggcguc

SEQ ID NO: 3178 - RNA, 20 nt, Homo sapiens
gcgcggaggcggaggcgucc

SEQ ID NO: 3179 - RNA, 20 nt, Homo sapiens
cgcggaggcggaggcguccg

SEQ ID NO: 3180 - RNA, 20 nt, Homo sapiens
gcggaggcggaggcguccgg

SEQ ID NO: 3181 - RNA, 20 nt, Homo sapiens
cggaggcggaggcguccggg

SEQ ID NO: 3182 - RNA, 20 nt, Homo sapiens
ggaggcggaggcguccgggg

SEQ ID NO: 3183 - RNA, 20 nt, Homo sapiens
gaggcggaggcguccggggg

SEQ ID NO: 3184 - RNA, 20 nt, Homo sapiens
aggcggaggcguccgggggc

SEQ ID NO: 3185 - RNA, 20 nt, Homo sapiens
ggcggaggcguccgggggcg

SEQ ID NO: 3186 - RNA, 20 nt, Homo sapiens
gcggaggcguccgggggcgc

SEQ ID NO: 3187 - RNA, 20 nt, Homo sapiens
cggaggcguccgggggcgcg

SEQ ID NO: 3188 - RNA, 20 nt, Homo sapiens
ggaggcguccgggggcgcgg

SEQ ID NO: 3189 - RNA, 20 nt, Homo sapiens
gaggcguccgggggcgcggg

SEQ ID NO: 3190 - RNA, 20 nt, Homo sapiens
aggcguccgggggcgcgggc

SEQ ID NO: 3191 - RNA, 20 nt, Homo sapiens
ggcguccgggggcgcgggcu

SEQ ID NO: 3192 - RNA, 20 nt, Homo sapiens
gcguccgggggcgcgggcug

SEQ ID NO: 3193 - RNA, 20 nt, Homo sapiens
cguccgggggcgcgggcugg

SEQ ID NO: 3194 - RNA, 20 nt, Homo sapiens
guccgggggcgcgggcuggg

SEQ ID NO: 3195 - RNA, 20 nt, Homo sapiens
uccgggggcgcgggcugggg

SEQ ID NO: 3196 - RNA, 20 nt, Homo sapiens
ccgggggcgcgggcugggga

SEQ ID NO: 3197 - RNA, 20 nt, Homo sapiens
cgggggcgcgggcuggggag

SEQ ID NO: 3198 - RNA, 20 nt, Homo sapiens
gggggcgcgggcuggggagg

SEQ ID NO: 3199 - RNA, 20 nt, Homo sapiens
ggggcgcgggcuggggaggu

SEQ ID NO: 3200 - RNA, 20 nt, Homo sapiens
gggcgcgggcuggggaggug

SEQ ID NO: 3201 - RNA, 20 nt, Homo sapiens
ggcgcgggcuggggaggugg

SEQ ID NO: 3202 - RNA, 20 nt, Homo sapiens
gcgcgggcuggggaggugga

SEQ ID NO: 3203 - RNA, 20 nt, Homo sapiens
cgcgggcuggggagguggag

SEQ ID NO: 3204 - RNA, 20 nt, Homo sapiens
gcgggcuggggagguggagc

SEQ ID NO: 3205 - RNA, 20 nt, Homo sapiens
cgggcuggggagguggagcu

SEQ ID NO: 3206 - RNA, 20 nt, Homo sapiens
gggcuggggagguggagcug

SEQ ID NO: 3207 - RNA, 20 nt, Homo sapiens
ggcuggggagguggagcugc

SEQ ID NO: 3208 - RNA, 20 nt, Homo sapiens
gcuggggagguggagcugcc

SEQ ID NO: 3209 - RNA, 20 nt, Homo sapiens
cuggggagguggagcugccc

SEQ ID NO: 3210 - RNA, 20 nt, Homo sapiens
uggggagguggagcugcccc

SEQ ID NO: 3211 - RNA, 20 nt, Homo sapiens
ggggagguggagcugccccg

SEQ ID NO: 3212 - RNA, 20 nt, Homo sapiens
gggagguggagcugccccgg

SEQ ID NO: 3213 - RNA, 20 nt, Homo sapiens
ggagguggagcugccccggc

SEQ ID NO: 3214 - RNA, 20 nt, Homo sapiens
gagguggagcugccccggcu

SEQ ID NO: 3215 - RNA, 20 nt, Homo sapiens
agguggagcugccccggcuu

SEQ ID NO: 3216 - RNA, 20 nt, Homo sapiens
gguggagcugccccggcuug

SEQ ID NO: 3217 - RNA, 20 nt, Homo sapiens
guggagcugccccggcuugg

SEQ ID NO: 3218 - RNA, 20 nt, Homo sapiens
uggagcugccccggcuuggg

SEQ ID NO: 3219 - RNA, 20 nt, Homo sapiens
ggagcugccccggcuugggg

SEQ ID NO: 3220 - RNA, 20 nt, Homo sapiens
gagcugccccggcuuggggu

SEQ ID NO: 3221 - RNA, 20 nt, Homo sapiens
agcugccccggcuugggguu

SEQ ID NO: 3222 - RNA, 20 nt, Homo sapiens
gcugccccggcuugggguuc

SEQ ID NO: 3223 - RNA, 20 nt, Homo sapiens
cugccccggcuugggguucc

SEQ ID NO: 3224 - RNA, 20 nt, Homo sapiens
ugccccggcuugggguuccc

SEQ ID NO: 3225 - RNA, 20 nt, Homo sapiens
gccccggcuugggguuccca

SEQ ID NO: 3226 - RNA, 20 nt, Homo sapiens
ccccggcuugggguucccac

SEQ ID NO: 3227 - RNA, 20 nt, Homo sapiens
cccggcuugggguucccacg

SEQ ID NO: 3228 - RNA, 20 nt, Homo sapiens
ccggcuugggguucccacgc

SEQ ID NO: 3229 - RNA, 20 nt, Homo sapiens
cggcuugggguucccacgcc

SEQ ID NO: 3230 - RNA, 20 nt, Homo sapiens
ggcuugggguucccacgccg

SEQ ID NO: 3231 - RNA, 20 nt, Homo sapiens
gcuugggguucccacgccgc

SEQ ID NO: 3232 - RNA, 20 nt, Homo sapiens
cuugggguucccacgccgcc

SEQ ID NO: 3233 - RNA, 20 nt, Homo sapiens
uugggguucccacgccgccc

SEQ ID NO: 3234 - RNA, 20 nt, Homo sapiens
ugggguucccacgccgcccc

SEQ ID NO: 3235 - RNA, 20 nt, Homo sapiens
gggguucccacgccgccccg

SEQ ID NO: 3236 - RNA, 20 nt, Homo sapiens
ggguucccacgccgccccgg

SEQ ID NO: 3237 - RNA, 20 nt, Homo sapiens
gguucccacgccgccccggc

SEQ ID NO: 3238 - RNA, 20 nt, Homo sapiens
guucccacgccgccccggcg

SEQ ID NO: 3239 - RNA, 20 nt, Homo sapiens
uucccacgccgccccggcga

SEQ ID NO: 3240 - RNA, 20 nt, Homo sapiens
ucccacgccgccccggcgac

SEQ ID NO: 3241 - RNA, 20 nt, Homo sapiens
cccacgccgccccggcgacc

SEQ ID NO: 3242 - RNA, 20 nt, Homo sapiens
ccacgccgccccggcgaccu

SEQ ID NO: 3243 - RNA, 20 nt, Homo sapiens
cacgccgccccggcgaccug

SEQ ID NO: 3244 - RNA, 20 nt, Homo sapiens
acgccgccccggcgaccugg

SEQ ID NO: 3245 - RNA, 20 nt, Homo sapiens
cgccgccccggcgaccuggg

SEQ ID NO: 3246 - RNA, 20 nt, Homo sapiens
gccgccccggcgaccugggg

SEQ ID NO: 3247 - RNA, 20 nt, Homo sapiens
ccgccccggcgaccugggga

SEQ ID NO: 3248 - RNA, 20 nt, Homo sapiens
cgccccggcgaccuggggac

SEQ ID NO: 3249 - RNA, 20 nt, Homo sapiens
gccccggcgaccuggggacc

SEQ ID NO: 3250 - RNA, 20 nt, Homo sapiens
ccccggcgaccuggggaccc

SEQ ID NO: 3251 - RNA, 20 nt, Homo sapiens
cccggcgaccuggggacccc

SEQ ID NO: 3252 - RNA, 20 nt, Homo sapiens
ccggcgaccuggggaccccg

SEQ ID NO: 3253 - RNA, 20 nt, Homo sapiens
cggcgaccuggggaccccgg

SEQ ID NO: 3254 - RNA, 20 nt, Homo sapiens
ggcgaccuggggaccccggc

SEQ ID NO: 3255 - RNA, 20 nt, Homo sapiens
gcgaccuggggaccccggcc

SEQ ID NO: 3256 - RNA, 20 nt, Homo sapiens
cgaccuggggaccccggccc

SEQ ID NO: 3257 - RNA, 20 nt, Homo sapiens
gaccuggggaccccggcccc

SEQ ID NO: 3258 - RNA, 20 nt, Homo sapiens
accuggggaccccggcccca

SEQ ID NO: 3259 - RNA, 20 nt, Homo sapiens
ccuggggaccccggccccag

SEQ ID NO: 3260 - RNA, 20 nt, Homo sapiens
cuggggaccccggccccagc

SEQ ID NO: 3261 - RNA, 20 nt, Homo sapiens
uggggaccccggccccagcc

SEQ ID NO: 3262 - RNA, 20 nt, Homo sapiens
ggggaccccggccccagccc

SEQ ID NO: 3263 - RNA, 20 nt, Homo sapiens
gggaccccggccccagcccc

SEQ ID NO: 3264 - RNA, 20 nt, Homo sapiens
ggaccccggccccagcccca

SEQ ID NO: 3265 - RNA, 20 nt, Homo sapiens
gaccccggccccagccccac

SEQ ID NO: 3266 - RNA, 20 nt, Homo sapiens
accccggccccagccccacc

SEQ ID NO: 3267 - RNA, 20 nt, Homo sapiens
ccccggccccagccccacca

SEQ ID NO: 3268 - RNA, 20 nt, Homo sapiens
cccggccccagccccaccac

SEQ ID NO: 3269 - RNA, 20 nt, Homo sapiens
ccggccccagccccaccacg

SEQ ID NO: 3270 - RNA, 20 nt, Homo sapiens
cggccccagccccaccacgg

SEQ ID NO: 3271 - RNA, 20 nt, Homo sapiens
ggccccagccccaccacgga

SEQ ID NO: 3272 - RNA, 20 nt, Homo sapiens
gccccagccccaccacggac

SEQ ID NO: 3273 - RNA, 20 nt, Homo sapiens
ccccagccccaccacggacu

SEQ ID NO: 3274 - RNA, 20 nt, Homo sapiens
cccagccccaccacggacuc

SEQ ID NO: 3275 - RNA, 20 nt, Homo sapiens
ccagccccaccacggacucc

SEQ ID NO: 3276 - RNA, 20 nt, Homo sapiens
cagccccaccacggacuccc

SEQ ID NO: 3277 - RNA, 20 nt, Homo sapiens
agccccaccacggacucccc

SEQ ID NO: 3278 - RNA, 20 nt, Homo sapiens
gccccaccacggacuccccu

SEQ ID NO: 3279 - RNA, 20 nt, Homo sapiens
ccccaccacggacuccccug

SEQ ID NO: 3280 - RNA, 20 nt, Homo sapiens
cccaccacggacuccccugg

SEQ ID NO: 3281 - RNA, 20 nt, Homo sapiens
ccaccacggacuccccuggg

SEQ ID NO: 3282 - RNA, 20 nt, Homo sapiens
caccacggacuccccuggga

SEQ ID NO: 3283 - RNA, 20 nt, Homo sapiens
accacggacuccccugggac

SEQ ID NO: 3284 - RNA, 20 nt, Homo sapiens
ccacggacuccccugggacg

SEQ ID NO: 3285 - RNA, 20 nt, Homo sapiens
cacggacuccccugggacgu

SEQ ID NO: 3286 - RNA, 20 nt, Homo sapiens
acggacuccccugggacgug

SEQ ID NO: 3287 - RNA, 20 nt, Homo sapiens
cggacuccccugggacgugg

SEQ ID NO: 3288 - RNA, 20 nt, Homo sapiens
ggacuccccugggacguggg

SEQ ID NO: 3289 - RNA, 20 nt, Homo sapiens
gacuccccugggacgugggu

SEQ ID NO: 3290 - RNA, 20 nt, Homo sapiens
acuccccugggacgugggug

SEQ ID NO: 3291 - RNA, 20 nt, Homo sapiens
cuccccugggacgugggugg

SEQ ID NO: 3292 - RNA, 20 nt, Homo sapiens
uccccugggacguggguggc

SEQ ID NO: 3293 - RNA, 20 nt, Homo sapiens
ccccugggacguggguggcg

SEQ ID NO: 3294 - RNA, 20 nt, Homo sapiens
cccugggacguggguggcgc

SEQ ID NO: 3295 - RNA, 20 nt, Homo sapiens
ccugggacguggguggcgca

SEQ ID NO: 3296 - RNA, 20 nt, Homo sapiens
cugggacguggguggcgcaa

SEQ ID NO: 3297 - RNA, 20 nt, Homo sapiens
ugggacguggguggcgcaag

SEQ ID NO: 3298 - RNA, 20 nt, Homo sapiens
gggacguggguggcgcaagc

SEQ ID NO: 3299 - RNA, 20 nt, Homo sapiens
ggacguggguggcgcaagca

SEQ ID NO: 3300 - RNA, 20 nt, Homo sapiens
gacguggguggcgcaagcac

SEQ ID NO: 3301 - RNA, 20 nt, Homo sapiens
acguggguggcgcaagcacc

SEQ ID NO: 3302 - RNA, 20 nt, Homo sapiens
cguggguggcgcaagcaccc

SEQ ID NO: 3303 - RNA, 20 nt, Homo sapiens
guggguggcgcaagcacccc

SEQ ID NO: 3304 - RNA, 20 nt, Homo sapiens
uggguggcgcaagcaccccu

SEQ ID NO: 3305 - RNA, 20 nt, Homo sapiens
ggguggcgcaagcaccccuu

SEQ ID NO: 3306 - RNA, 20 nt, Homo sapiens
gguggcgcaagcaccccuug

SEQ ID NO: 3307 - RNA, 20 nt, Homo sapiens
guggcgcaagcaccccuugg

SEQ ID NO: 3308 - RNA, 20 nt, Homo sapiens
uggcgcaagcaccccuuggc

SEQ ID NO: 3309 - RNA, 20 nt, Homo sapiens
ggcgcaagcaccccuuggcc

SEQ ID NO: 3310 - RNA, 20 nt, Homo sapiens
gcgcaagcaccccuuggccc

SEQ ID NO: 3311 - RNA, 20 nt, Homo sapiens
cgcaagcaccccuuggcccu

SEQ ID NO: 3312 - RNA, 20 nt, Homo sapiens
gcaagcaccccuuggcccug

SEQ ID NO: 3313 - RNA, 20 nt, Homo sapiens
caagcaccccuuggcccugc

SEQ ID NO: 3314 - RNA, 20 nt, Homo sapiens
aagcaccccuuggcccugcg

SEQ ID NO: 3315 - RNA, 20 nt, Homo sapiens
agcaccccuuggcccugcgg

SEQ ID NO: 3316 - RNA, 20 nt, Homo sapiens
gcaccccuuggcccugcggc

SEQ ID NO: 3317 - RNA, 20 nt, Homo sapiens
caccccuuggcccugcggcc

SEQ ID NO: 3318 - RNA, 20 nt, Homo sapiens
accccuuggcccugcggccc

SEQ ID NO: 3319 - RNA, 20 nt, Homo sapiens
ccccuuggcccugcggcccc

SEQ ID NO: 3320 - RNA, 20 nt, Homo sapiens
cccuuggcccugcggccccg

SEQ ID NO: 3321 - RNA, 20 nt, Homo sapiens
ccuuggcccugcggccccgc

SEQ ID NO: 3322 - RNA, 20 nt, Homo sapiens
cuuggcccugcggccccgcu

SEQ ID NO: 3323 - RNA, 20 nt, Homo sapiens
uuggcccugcggccccgcuu

SEQ ID NO: 3324 - RNA, 20 nt, Homo sapiens
uggcccugcggccccgcuug

SEQ ID NO: 3325 - RNA, 20 nt, Homo sapiens
ggcccugcggccccgcuuga

SEQ ID NO: 3326 - RNA, 20 nt, Homo sapiens
gcccugcggccccgcuugag

SEQ ID NO: 3327 - RNA, 20 nt, Homo sapiens
cccugcggccccgcuugagc

SEQ ID NO: 3328 - RNA, 20 nt, Homo sapiens
ccugcggccccgcuugagcg

SEQ ID NO: 3329 - RNA, 20 nt, Homo sapiens
cugcggccccgcuugagcgg

SEQ ID NO: 3330 - RNA, 20 nt, Homo sapiens
ugcggccccgcuugagcggg

SEQ ID NO: 3331 - RNA, 20 nt, Homo sapiens
gcggccccgcuugagcgggc

SEQ ID NO: 3332 - RNA, 20 nt, Homo sapiens
cggccccgcuugagcgggcc

SEQ ID NO: 3333 - RNA, 20 nt, Homo sapiens
ggccccgcuugagcgggccc

SEQ ID NO: 3334 - RNA, 20 nt, Homo sapiens
gccccgcuugagcgggccca

SEQ ID NO: 3335 - RNA, 20 nt, Homo sapiens
ccccgcuugagcgggcccag

SEQ ID NO: 3336 - RNA, 20 nt, Homo sapiens
cccgcuugagcgggcccagg

SEQ ID NO: 3337 - RNA, 20 nt, Homo sapiens
ccgcuugagcgggcccaggc

SEQ ID NO: 3338 - RNA, 20 nt, Homo sapiens
cgcuugagcgggcccaggcu

SEQ ID NO: 3339 - RNA, 20 nt, Homo sapiens
gcuugagcgggcccaggcug

SEQ ID NO: 3340 - RNA, 20 nt, Homo sapiens
cuugagcgggcccaggcugu

SEQ ID NO: 3341 - RNA, 20 nt, Homo sapiens
uugagcgggcccaggcugug

SEQ ID NO: 3342 - RNA, 20 nt, Homo sapiens
ugagcgggcccaggcugugc

SEQ ID NO: 3343 - RNA, 20 nt, Homo sapiens
gagcgggcccaggcugugcc

SEQ ID NO: 3344 - RNA, 20 nt, Homo sapiens
agcgggcccaggcugugcca

SEQ ID NO: 3345 - RNA, 20 nt, Homo sapiens
gcgggcccaggcugugccac

SEQ ID NO: 3346 - RNA, 20 nt, Homo sapiens
cgggcccaggcugugccacc

SEQ ID NO: 3347 - RNA, 20 nt, Homo sapiens
gggcccaggcugugccaccg

SEQ ID NO: 3348 - RNA, 20 nt, Homo sapiens
ggcccaggcugugccaccgc

SEQ ID NO: 3349 - RNA, 20 nt, Homo sapiens
gcccaggcugugccaccgcg

SEQ ID NO: 3350 - RNA, 20 nt, Homo sapiens
cccaggcugugccaccgcgc

SEQ ID NO: 3351 - RNA, 20 nt, Homo sapiens
ccaggcugugccaccgcgca

SEQ ID NO: 3352 - RNA, 20 nt, Homo sapiens
caggcugugccaccgcgcag

SEQ ID NO: 3353 - RNA, 20 nt, Homo sapiens
aggcugugccaccgcgcagg

SEQ ID NO: 3354 - RNA, 20 nt, Homo sapiens
ggcugugccaccgcgcaggg

SEQ ID NO: 3355 - RNA, 20 nt, Homo sapiens
gcugugccaccgcgcagggg

SEQ ID NO: 3356 - RNA, 20 nt, Homo sapiens
cugugccaccgcgcaggggc

SEQ ID NO: 3357 - RNA, 20 nt, Homo sapiens
ugugccaccgcgcaggggcc

SEQ ID NO: 3358 - RNA, 20 nt, Homo sapiens
gugccaccgcgcaggggccc

SEQ ID NO: 3359 - RNA, 20 nt, Homo sapiens
ugccaccgcgcaggggcccg

SEQ ID NO: 3360 - RNA, 20 nt, Homo sapiens
gccaccgcgcaggggcccgg

SEQ ID NO: 3361 - RNA, 20 nt, Homo sapiens
ccaccgcgcaggggcccggc

SEQ ID NO: 3362 - RNA, 20 nt, Homo sapiens
caccgcgcaggggcccggca

SEQ ID NO: 3363 - RNA, 20 nt, Homo sapiens
accgcgcaggggcccggcag

SEQ ID NO: 3364 - RNA, 20 nt, Homo sapiens
ccgcgcaggggcccggcagg

SEQ ID NO: 3365 - RNA, 20 nt, Homo sapiens
cgcgcaggggcccggcaggc

SEQ ID NO: 3366 - RNA, 20 nt, Homo sapiens
gcgcaggggcccggcaggcc

SEQ ID NO: 3367 - RNA, 20 nt, Homo sapiens
cgcaggggcccggcaggccg

SEQ ID NO: 3368 - RNA, 20 nt, Homo sapiens
gcaggggcccggcaggccgu

SEQ ID NO: 3369 - RNA, 20 nt, Homo sapiens
caggggcccggcaggccguc

SEQ ID NO: 3370 - RNA, 20 nt, Homo sapiens
aggggcccggcaggccgucg

SEQ ID NO: 3371 - RNA, 20 nt, Homo sapiens
ggggcccggcaggccgucgc

SEQ ID NO: 3372 - RNA, 20 nt, Homo sapiens
gggcccggcaggccgucgcg

SEQ ID NO: 3373 - RNA, 20 nt, Homo sapiens
ggcccggcaggccgucgcgc

SEQ ID NO: 3374 - RNA, 20 nt, Homo sapiens
gcccggcaggccgucgcgcu

SEQ ID NO: 3375 - RNA, 20 nt, Homo sapiens
cccggcaggccgucgcgcug

SEQ ID NO: 3376 - RNA, 20 nt, Homo sapiens
ccggcaggccgucgcgcugc

SEQ ID NO: 3377 - RNA, 20 nt, Homo sapiens
cggcaggccgucgcgcugcg

SEQ ID NO: 3378 - RNA, 20 nt, Homo sapiens
ggcaggccgucgcgcugcgg

SEQ ID NO: 3379 - RNA, 20 nt, Homo sapiens
gcaggccgucgcgcugcggg

SEQ ID NO: 3380 - RNA, 20 nt, Homo sapiens
caggccgucgcgcugcgggu

SEQ ID NO: 3381 - RNA, 20 nt, Homo sapiens
aggccgucgcgcugcggguc

SEQ ID NO: 3382 - RNA, 20 nt, Homo sapiens
ggccgucgcgcugcgggucc

SEQ ID NO: 3383 - RNA, 20 nt, Homo sapiens
gccgucgcgcugcggguccc

SEQ ID NO: 3384 - RNA, 20 nt, Homo sapiens
ccgucgcgcugcgggucccg

SEQ ID NO: 3385 - RNA, 20 nt, Homo sapiens
cgucgcgcugcgggucccgg

SEQ ID NO: 3386 - RNA, 20 nt, Homo sapiens
gucgcgcugcgggucccggu

SEQ ID NO: 3387 - RNA, 20 nt, Homo sapiens
ucgcgcugcgggucccgguc

SEQ ID NO: 3388 - RNA, 20 nt, Homo sapiens
cgcgcugcgggucccggucc

SEQ ID NO: 3389 - RNA, 20 nt, Homo sapiens
gcgcugcgggucccgguccu

SEQ ID NO: 3390 - RNA, 20 nt, Homo sapiens
cgcugcgggucccgguccuc

SEQ ID NO: 3391 - RNA, 20 nt, Homo sapiens
gcugcgggucccgguccucc

SEQ ID NO: 3392 - RNA, 20 nt, Homo sapiens
cugcgggucccgguccuccc

SEQ ID NO: 3393 - RNA, 20 nt, Homo sapiens
ugcgggucccgguccucccg

SEQ ID NO: 3394 - RNA, 20 nt, Homo sapiens
gcgggucccgguccucccgg

SEQ ID NO: 3395 - RNA, 20 nt, Homo sapiens
cgggucccgguccucccggc

SEQ ID NO: 3396 - RNA, 20 nt, Homo sapiens
gggucccgguccucccggcu

SEQ ID NO: 3397 - RNA, 20 nt, Homo sapiens
ggucccgguccucccggcuu

SEQ ID NO: 3398 - RNA, 20 nt, Homo sapiens
gucccgguccucccggcuuu

SEQ ID NO: 3399 - RNA, 20 nt, Homo sapiens
ucccgguccucccggcuuuu

SEQ ID NO: 3400 - RNA, 20 nt, Homo sapiens
cccgguccucccggcuuuug

SEQ ID NO: 3401 - RNA, 20 nt, Homo sapiens
ccgguccucccggcuuuugc

SEQ ID NO: 3402 - RNA, 20 nt, Homo sapiens
cgguccucccggcuuuugcc

SEQ ID NO: 3403 - RNA, 20 nt, Homo sapiens
gguccucccggcuuuugccc

SEQ ID NO: 3404 - RNA, 20 nt, Homo sapiens
guccucccggcuuuugcccg

SEQ ID NO: 3405 - RNA, 20 nt, Homo sapiens
uccucccggcuuuugcccgg

SEQ ID NO: 3406 - RNA, 20 nt, Homo sapiens
ccucccggcuuuugcccggg

SEQ ID NO: 3407 - RNA, 20 nt, Homo sapiens
cucccggcuuuugcccgggu

SEQ ID NO: 3408 - RNA, 20 nt, Homo sapiens
ucccggcuuuugcccgggug

SEQ ID NO: 3409 - RNA, 20 nt, Homo sapiens
cccggcuuuugcccgggugc

SEQ ID NO: 3410 - RNA, 20 nt, Homo sapiens
ccggcuuuugcccgggugcg

SEQ ID NO: 3411 - RNA, 20 nt, Homo sapiens
cggcuuuugcccgggugcgg

SEQ ID NO: 3412 - RNA, 20 nt, Homo sapiens
ggcuuuugcccgggugcgga

SEQ ID NO: 3413 - RNA, 20 nt, Homo sapiens
gcuuuugcccgggugcggag

SEQ ID NO: 3414 - RNA, 20 nt, Homo sapiens
cuuuugcccgggugcggagg

SEQ ID NO: 3415 - RNA, 20 nt, Homo sapiens
uuuugcccgggugcggaggc

SEQ ID NO: 3416 - RNA, 20 nt, Homo sapiens
uuugcccgggugcggaggcc

SEQ ID NO: 3417 - RNA, 20 nt, Homo sapiens
uugcccgggugcggaggcca

SEQ ID NO: 3418 - RNA, 20 nt, Homo sapiens
ugcccgggugcggaggccag

SEQ ID NO: 3419 - RNA, 20 nt, Homo sapiens
gcccgggugcggaggccagc

SEQ ID NO: 3420 - RNA, 20 nt, Homo sapiens
cccgggugcggaggccagcg

SEQ ID NO: 3421 - RNA, 20 nt, Homo sapiens
ccgggugcggaggccagcga

SEQ ID NO: 3422 - RNA, 20 nt, Homo sapiens
cgggugcggaggccagcgag

SEQ ID NO: 3423 - RNA, 20 nt, Homo sapiens
gggugcggaggccagcgagg

SEQ ID NO: 3424 - RNA, 20 nt, Homo sapiens
ggugcggaggccagcgagga

SEQ ID NO: 3425 - RNA, 20 nt, Homo sapiens
gugcggaggccagcgaggag

SEQ ID NO: 3426 - RNA, 20 nt, Homo sapiens
ugcggaggccagcgaggagc

SEQ ID NO: 3427 - RNA, 20 nt, Homo sapiens
gcggaggccagcgaggagcc

SEQ ID NO: 3428 - RNA, 20 nt, Homo sapiens
cggaggccagcgaggagccu

SEQ ID NO: 3429 - RNA, 20 nt, Homo sapiens
ggaggccagcgaggagccug

SEQ ID NO: 3430 - RNA, 20 nt, Homo sapiens
gaggccagcgaggagccuga

SEQ ID NO: 3431 - RNA, 20 nt, Homo sapiens
aggccagcgaggagccugag

SEQ ID NO: 3432 - RNA, 20 nt, Homo sapiens
ggccagcgaggagccugagg

SEQ ID NO: 3433 - RNA, 20 nt, Homo sapiens
gccagcgaggagccugaggg

SEQ ID NO: 3434 - RNA, 20 nt, Homo sapiens
ccagcgaggagccugagggu

SEQ ID NO: 3435 - RNA, 20 nt, Homo sapiens
cagcgaggagccugagggug

SEQ ID NO: 3436 - RNA, 20 nt, Homo sapiens
agcgaggagccugagggugg

SEQ ID NO: 3437 - RNA, 20 nt, Homo sapiens
gcgaggagccugaggguggg

SEQ ID NO: 3438 - RNA, 20 nt, Homo sapiens
cgaggagccugaggguggga

SEQ ID NO: 3439 - RNA, 20 nt, Homo sapiens
gaggagccugagggugggag

SEQ ID NO: 3440 - RNA, 20 nt, Homo sapiens
aggagccugagggugggaga

SEQ ID NO: 3441 - RNA, 20 nt, Homo sapiens
ggagccugagggugggagag

SEQ ID NO: 3442 - RNA, 20 nt, Homo sapiens
gagccugagggugggagagc

SEQ ID NO: 3443 - RNA, 20 nt, Homo sapiens
agccugagggugggagagcg

SEQ ID NO: 3444 - RNA, 20 nt, Homo sapiens
gccugagggugggagagcgc

SEQ ID NO: 3445 - RNA, 20 nt, Homo sapiens
ccugagggugggagagcgcc

SEQ ID NO: 3446 - RNA, 20 nt, Homo sapiens
cugagggugggagagcgccc

SEQ ID NO: 3447 - RNA, 20 nt, Homo sapiens
ugagggugggagagcgcccc

SEQ ID NO: 3448 - RNA, 20 nt, Homo sapiens
gagggugggagagcgccccg

SEQ ID NO: 3449 - RNA, 20 nt, Homo sapiens
agggugggagagcgccccgu

SEQ ID NO: 3450 - RNA, 20 nt, Homo sapiens
gggugggagagcgccccguc

SEQ ID NO: 3451 - RNA, 20 nt, Homo sapiens
ggugggagagcgccccgucc

SEQ ID NO: 3452 - RNA, 20 nt, Homo sapiens
gugggagagcgccccguccg

SEQ ID NO: 3453 - RNA, 20 nt, Homo sapiens
ugggagagcgccccguccgg

SEQ ID NO: 3454 - RNA, 20 nt, Homo sapiens
gggagagcgccccguccgga

SEQ ID NO: 3455 - RNA, 20 nt, Homo sapiens
ggagagcgccccguccggag

SEQ ID NO: 3456 - RNA, 20 nt, Homo sapiens
gagagcgccccguccggagg

SEQ ID NO: 3457 - RNA, 20 nt, Homo sapiens
agagcgccccguccggagga

SEQ ID NO: 3458 - RNA, 20 nt, Homo sapiens
gagcgccccguccggaggag

SEQ ID NO: 3459 - RNA, 20 nt, Homo sapiens
agcgccccguccggaggagc

SEQ ID NO: 3460 - RNA, 20 nt, Homo sapiens
gcgccccguccggaggagcc

SEQ ID NO: 3461 - RNA, 20 nt, Homo sapiens
cgccccguccggaggagccg

SEQ ID NO: 3462 - RNA, 20 nt, Homo sapiens
gccccguccggaggagccgg

SEQ ID NO: 3463 - RNA, 20 nt, Homo sapiens
ccccguccggaggagccggg

SEQ ID NO: 3464 - RNA, 20 nt, Homo sapiens
cccguccggaggagccgggg

SEQ ID NO: 3465 - RNA, 20 nt, Homo sapiens
ccguccggaggagccggggc

SEQ ID NO: 3466 - RNA, 20 nt, Homo sapiens
cguccggaggagccggggcg

SEQ ID NO: 3467 - RNA, 20 nt, Homo sapiens
guccggaggagccggggcgg

SEQ ID NO: 3468 - RNA, 20 nt, Homo sapiens
uccggaggagccggggcggc

SEQ ID NO: 3469 - RNA, 20 nt, Homo sapiens
ccggaggagccggggcggcg

SEQ ID NO: 3470 - RNA, 20 nt, Homo sapiens
cggaggagccggggcggcgu

SEQ ID NO: 3471 - RNA, 20 nt, Homo sapiens
ggaggagccggggcggcgua

SEQ ID NO: 3472 - RNA, 20 nt, Homo sapiens
gaggagccggggcggcguag

SEQ ID NO: 3473 - RNA, 20 nt, Homo sapiens
aggagccggggcggcguagg

SEQ ID NO: 3474 - RNA, 20 nt, Homo sapiens
ggagccggggcggcguaggc

SEQ ID NO: 3475 - RNA, 20 nt, Homo sapiens
gagccggggcggcguaggcg

SEQ ID NO: 3476 - RNA, 20 nt, Homo sapiens
agccggggcggcguaggcga

SEQ ID NO: 3477 - RNA, 20 nt, Homo sapiens
gccggggcggcguaggcgaa

SEQ ID NO: 3478 - RNA, 20 nt, Homo sapiens
ccggggcggcguaggcgaaa

SEQ ID NO: 3479 - RNA, 20 nt, Homo sapiens
cggggcggcguaggcgaaau

SEQ ID NO: 3480 - RNA, 20 nt, Homo sapiens
ggggcggcguaggcgaaauc

SEQ ID NO: 3481 - RNA, 20 nt, Homo sapiens
gggcggcguaggcgaaaucc

SEQ ID NO: 3482 - RNA, 20 nt, Homo sapiens
ggcggcguaggcgaaauccc

SEQ ID NO: 3483 - RNA, 20 nt, Homo sapiens
gcggcguaggcgaaaucccc

SEQ ID NO: 3484 - RNA, 20 nt, Homo sapiens
cggcguaggcgaaauccccg

SEQ ID NO: 3485 - RNA, 20 nt, Homo sapiens
ggcguaggcgaaauccccgc

SEQ ID NO: 3486 - RNA, 20 nt, Homo sapiens
gcguaggcgaaauccccgcg

SEQ ID NO: 3487 - RNA, 20 nt, Homo sapiens
cguaggcgaaauccccgcgc

SEQ ID NO: 3488 - RNA, 20 nt, Homo sapiens
guaggcgaaauccccgcgcg

SEQ ID NO: 3489 - RNA, 20 nt, Homo sapiens
uaggcgaaauccccgcgcgc

SEQ ID NO: 3490 - RNA, 20 nt, Homo sapiens
aggcgaaauccccgcgcgcc

SEQ ID NO: 3491 - RNA, 20 nt, Homo sapiens
ggcgaaauccccgcgcgccg

SEQ ID NO: 3492 - RNA, 20 nt, Homo sapiens
gcgaaauccccgcgcgccgg

SEQ ID NO: 3493 - RNA, 20 nt, Homo sapiens
cgaaauccccgcgcgccggg

SEQ ID NO: 3494 - RNA, 20 nt, Homo sapiens
gaaauccccgcgcgccgggg

SEQ ID NO: 3495 - RNA, 20 nt, Homo sapiens
aaauccccgcgcgccggggc

SEQ ID NO: 3496 - RNA, 20 nt, Homo sapiens
aauccccgcgcgccggggca

SEQ ID NO: 3497 - RNA, 20 nt, Homo sapiens
auccccgcgcgccggggcag

SEQ ID NO: 3498 - RNA, 20 nt, Homo sapiens
uccccgcgcgccggggcagg

SEQ ID NO: 3499 - RNA, 20 nt, Homo sapiens
ccccgcgcgccggggcaggu

SEQ ID NO: 3500 - RNA, 20 nt, Homo sapiens
cccgcgcgccggggcagguu

SEQ ID NO: 3501 - RNA, 20 nt, Homo sapiens
ccgcgcgccggggcagguug

SEQ ID NO: 3502 - RNA, 20 nt, Homo sapiens
cgcgcgccggggcagguugg

SEQ ID NO: 3503 - RNA, 20 nt, Homo sapiens
gcgcgccggggcagguuggg

SEQ ID NO: 3504 - RNA, 20 nt, Homo sapiens
cgcgccggggcagguuggga

SEQ ID NO: 3505 - RNA, 20 nt, Homo sapiens
gcgccggggcagguugggag

SEQ ID NO: 3506 - RNA, 20 nt, Homo sapiens
cgccggggcagguugggaga

SEQ ID NO: 3507 - RNA, 20 nt, Homo sapiens
gccggggcagguugggagau

SEQ ID NO: 3508 - RNA, 20 nt, Homo sapiens
ccggggcagguugggagauc

SEQ ID NO: 3509 - RNA, 20 nt, Homo sapiens
cggggcagguugggagaucc

SEQ ID NO: 3510 - RNA, 20 nt, Homo sapiens
ggggcagguugggagauccc

SEQ ID NO: 3511 - RNA, 20 nt, Homo sapiens
gggcagguugggagaucccc

SEQ ID NO: 3512 - RNA, 20 nt, Homo sapiens
ggcagguugggagauccccu

SEQ ID NO: 3513 - RNA, 20 nt, Homo sapiens
gcagguugggagauccccuc

SEQ ID NO: 3514 - RNA, 20 nt, Homo sapiens
cagguugggagauccccucu

SEQ ID NO: 3515 - RNA, 20 nt, Homo sapiens
agguugggagauccccucug

SEQ ID NO: 3516 - RNA, 20 nt, Homo sapiens
gguugggagauccccucugc

SEQ ID NO: 3517 - RNA, 20 nt, Homo sapiens
guugggagauccccucugcc

SEQ ID NO: 3518 - RNA, 20 nt, Homo sapiens
uugggagauccccucugccg

SEQ ID NO: 3519 - RNA, 20 nt, Homo sapiens
ugggagauccccucugccgg

SEQ ID NO: 3520 - RNA, 20 nt, Homo sapiens
gggagauccccucugccggc

SEQ ID NO: 3521 - RNA, 20 nt, Homo sapiens
ggagauccccucugccggcg

SEQ ID NO: 3522 - RNA, 20 nt, Homo sapiens
gagauccccucugccggcgc

SEQ ID NO: 3523 - RNA, 20 nt, Homo sapiens
agauccccucugccggcgcg

SEQ ID NO: 3524 - RNA, 20 nt, Homo sapiens
gauccccucugccggcgcgg

SEQ ID NO: 3525 - RNA, 20 nt, Homo sapiens
auccccucugccggcgcggc

SEQ ID NO: 3526 - RNA, 20 nt, Homo sapiens
uccccucugccggcgcggcc

SEQ ID NO: 3527 - RNA, 20 nt, Homo sapiens
ccccucugccggcgcggccu

SEQ ID NO: 3528 - RNA, 20 nt, Homo sapiens
cccucugccggcgcggccug

SEQ ID NO: 3529 - RNA, 20 nt, Homo sapiens
ccucugccggcgcggccugg

SEQ ID NO: 3530 - RNA, 20 nt, Homo sapiens
cucugccggcgcggccuggc

SEQ ID NO: 3531 - RNA, 20 nt, Homo sapiens
ucugccggcgcggccuggcu

SEQ ID NO: 3532 - RNA, 20 nt, Homo sapiens
cugccggcgcggccuggcug

SEQ ID NO: 3533 - RNA, 20 nt, Homo sapiens
ugccggcgcggccuggcugg

SEQ ID NO: 3534 - RNA, 20 nt, Homo sapiens
gccggcgcggccuggcuggg

SEQ ID NO: 3535 - RNA, 20 nt, Homo sapiens
ccggcgcggccuggcugggc

SEQ ID NO: 3536 - RNA, 20 nt, Homo sapiens
cggcgcggccuggcugggcu

SEQ ID NO: 3537 - RNA, 20 nt, Homo sapiens
ggcgcggccuggcugggcug

SEQ ID NO: 3538 - RNA, 20 nt, Homo sapiens
gcgcggccuggcugggcugc

SEQ ID NO: 3539 - RNA, 20 nt, Homo sapiens
cgcggccuggcugggcugca

SEQ ID NO: 3540 - RNA, 20 nt, Homo sapiens
gcggccuggcugggcugcag

SEQ ID NO: 3541 - RNA, 20 nt, Homo sapiens
cggccuggcugggcugcagc

SEQ ID NO: 3542 - RNA, 20 nt, Homo sapiens
ggccuggcugggcugcagcg

SEQ ID NO: 3543 - RNA, 20 nt, Homo sapiens
gccuggcugggcugcagcgc

SEQ ID NO: 3544 - RNA, 20 nt, Homo sapiens
ccuggcugggcugcagcgcg

SEQ ID NO: 3545 - RNA, 20 nt, Homo sapiens
cuggcugggcugcagcgcgg

SEQ ID NO: 3546 - RNA, 20 nt, Homo sapiens
uggcugggcugcagcgcggg

SEQ ID NO: 3547 - RNA, 20 nt, Homo sapiens
ggcugggcugcagcgcgggg

SEQ ID NO: 3548 - RNA, 20 nt, Homo sapiens
gcugggcugcagcgcggggg

SEQ ID NO: 3549 - RNA, 20 nt, Homo sapiens
cugggcugcagcgcgggggc

SEQ ID NO: 3550 - RNA, 20 nt, Homo sapiens
ugggcugcagcgcgggggcg

SEQ ID NO: 3551 - RNA, 20 nt, Homo sapiens
gggcugcagcgcgggggcgg

SEQ ID NO: 3552 - RNA, 20 nt, Homo sapiens
ggcugcagcgcgggggcggc

SEQ ID NO: 3553 - RNA, 20 nt, Homo sapiens
gcugcagcgcgggggcggcc

SEQ ID NO: 3554 - RNA, 20 nt, Homo sapiens
cugcagcgcgggggcggccc

SEQ ID NO: 3555 - RNA, 20 nt, Homo sapiens
ugcagcgcgggggcggcccu

SEQ ID NO: 3556 - RNA, 20 nt, Homo sapiens
gcagcgcgggggcggcccuc

SEQ ID NO: 3557 - RNA, 20 nt, Homo sapiens
cagcgcgggggcggcccucg

SEQ ID NO: 3558 - RNA, 20 nt, Homo sapiens
agcgcgggggcggcccucgc

SEQ ID NO: 3559 - RNA, 20 nt, Homo sapiens
gcgcgggggcggcccucgcu

SEQ ID NO: 3560 - RNA, 20 nt, Homo sapiens
cgcgggggcggcccucgcug

SEQ ID NO: 3561 - RNA, 20 nt, Homo sapiens
gcgggggcggcccucgcugc

SEQ ID NO: 3562 - RNA, 20 nt, Homo sapiens
cgggggcggcccucgcugcc

SEQ ID NO: 3563 - RNA, 20 nt, Homo sapiens
gggggcggcccucgcugccu

SEQ ID NO: 3564 - RNA, 20 nt, Homo sapiens
ggggcggcccucgcugccug

SEQ ID NO: 3565 - RNA, 20 nt, Homo sapiens
gggcggcccucgcugccugg

SEQ ID NO: 3566 - RNA, 20 nt, Homo sapiens
ggcggcccucgcugccuggc

SEQ ID NO: 3567 - RNA, 20 nt, Homo sapiens
gcggcccucgcugccuggcu

SEQ ID NO: 3568 - RNA, 20 nt, Homo sapiens
cggcccucgcugccuggcuc

SEQ ID NO: 3569 - RNA, 20 nt, Homo sapiens
ggcccucgcugccuggcuca

SEQ ID NO: 3570 - RNA, 20 nt, Homo sapiens
gcccucgcugccuggcucac

SEQ ID NO: 3571 - RNA, 20 nt, Homo sapiens
cccucgcugccuggcucacg

SEQ ID NO: 3572 - RNA, 20 nt, Homo sapiens
ccucgcugccuggcucacga

SEQ ID NO: 3573 - RNA, 20 nt, Homo sapiens
cucgcugccuggcucacgaa

SEQ ID NO: 3574 - RNA, 20 nt, Homo sapiens
ucgcugccuggcucacgaaa

SEQ ID NO: 3575 - RNA, 20 nt, Homo sapiens
cgcugccuggcucacgaaag

SEQ ID NO: 3576 - RNA, 20 nt, Homo sapiens
gcugccuggcucacgaaagc

SEQ ID NO: 3577 - RNA, 20 nt, Homo sapiens
cugccuggcucacgaaagcc

SEQ ID NO: 3578 - RNA, 20 nt, Homo sapiens
ugccuggcucacgaaagccc

SEQ ID NO: 3579 - RNA, 20 nt, Homo sapiens
gccuggcucacgaaagcccc

SEQ ID NO: 3580 - RNA, 20 nt, Homo sapiens
ccuggcucacgaaagccccc

SEQ ID NO: 3581 - RNA, 20 nt, Homo sapiens
cuggcucacgaaagcccccu

SEQ ID NO: 3582 - RNA, 20 nt, Homo sapiens
uggcucacgaaagcccccug

SEQ ID NO: 3583 - RNA, 20 nt, Homo sapiens
ggcucacgaaagcccccugu

SEQ ID NO: 3584 - RNA, 20 nt, Homo sapiens
gcucacgaaagcccccugug

SEQ ID NO: 3585 - RNA, 20 nt, Homo sapiens
cucacgaaagcccccugugg

SEQ ID NO: 3586 - RNA, 20 nt, Homo sapiens
ucacgaaagcccccuguggg

SEQ ID NO: 3587 - RNA, 20 nt, Homo sapiens
cacgaaagcccccuguggga

SEQ ID NO: 3588 - RNA, 20 nt, Homo sapiens
acgaaagcccccugugggag

SEQ ID NO: 3589 - RNA, 20 nt, Homo sapiens
cgaaagcccccugugggaga

SEQ ID NO: 3590 - RNA, 20 nt, Homo sapiens
gaaagcccccugugggagag

SEQ ID NO: 3591 - RNA, 20 nt, Homo sapiens
aaagcccccugugggagagc

SEQ ID NO: 3592 - RNA, 20 nt, Homo sapiens
aagcccccugugggagagcc

SEQ ID NO: 3593 - RNA, 20 nt, Homo sapiens
agcccccugugggagagccc

SEQ ID NO: 3594 - RNA, 20 nt, Homo sapiens
gcccccugugggagagcccc

SEQ ID NO: 3595 - RNA, 20 nt, Homo sapiens
cccccugugggagagcccca

SEQ ID NO: 3596 - RNA, 20 nt, Homo sapiens
ccccugugggagagccccag

SEQ ID NO: 3597 - RNA, 20 nt, Homo sapiens
cccugugggagagccccagg

SEQ ID NO: 3598 - RNA, 20 nt, Homo sapiens
ccugugggagagccccaggc

SEQ ID NO: 3599 - RNA, 20 nt, Homo sapiens
cugugggagagccccaggcg

SEQ ID NO: 3600 - RNA, 20 nt, Homo sapiens
ugugggagagccccaggcgc

SEQ ID NO: 3601 - RNA, 20 nt, Homo sapiens
gugggagagccccaggcgcg

SEQ ID NO: 3602 - RNA, 20 nt, Homo sapiens
ugggagagccccaggcgcgc

SEQ ID NO: 3603 - RNA, 20 nt, Homo sapiens
gggagagccccaggcgcgca

SEQ ID NO: 3604 - RNA, 20 nt, Homo sapiens
ggagagccccaggcgcgcag

SEQ ID NO: 3605 - RNA, 20 nt, Homo sapiens
gagagccccaggcgcgcagg

SEQ ID NO: 3606 - RNA, 20 nt, Homo sapiens
agagccccaggcgcgcaggg

SEQ ID NO: 3607 - RNA, 20 nt, Homo sapiens
gagccccaggcgcgcagggc

SEQ ID NO: 3608 - RNA, 20 nt, Homo sapiens
agccccaggcgcgcagggca

SEQ ID NO: 3609 - RNA, 20 nt, Homo sapiens
gccccaggcgcgcagggcac

SEQ ID NO: 3610 - RNA, 20 nt, Homo sapiens
ccccaggcgcgcagggcacg

SEQ ID NO: 3611 - RNA, 20 nt, Homo sapiens
cccaggcgcgcagggcacgu

SEQ ID NO: 3612 - RNA, 20 nt, Homo sapiens
ccaggcgcgcagggcacgug

SEQ ID NO: 3613 - RNA, 20 nt, Homo sapiens
caggcgcgcagggcacgugg

SEQ ID NO: 3614 - RNA, 20 nt, Homo sapiens
aggcgcgcagggcacguggg

SEQ ID NO: 3615 - RNA, 20 nt, Homo sapiens
ggcgcgcagggcacgugggg

SEQ ID NO: 3616 - RNA, 20 nt, Homo sapiens
gcgcgcagggcacguggggu

SEQ ID NO: 3617 - RNA, 20 nt, Homo sapiens
cgcgcagggcacguggggug

SEQ ID NO: 3618 - RNA, 20 nt, Homo sapiens
gcgcagggcacguggggugc

SEQ ID NO: 3619 - RNA, 20 nt, Homo sapiens
cgcagggcacguggggugcg

SEQ ID NO: 3620 - RNA, 20 nt, Homo sapiens
gcagggcacguggggugcgg

SEQ ID NO: 3621 - RNA, 20 nt, Homo sapiens
cagggcacguggggugcggg

SEQ ID NO: 3622 - RNA, 20 nt, Homo sapiens
agggcacguggggugcggga

SEQ ID NO: 3623 - RNA, 20 nt, Homo sapiens
gggcacguggggugcgggaa

SEQ ID NO: 3624 - RNA, 20 nt, Homo sapiens
ggcacguggggugcgggaag

SEQ ID NO: 3625 - RNA, 20 nt, Homo sapiens
gcacguggggugcgggaagc

SEQ ID NO: 3626 - RNA, 20 nt, Homo sapiens
cacguggggugcgggaagcc

SEQ ID NO: 3627 - RNA, 20 nt, Homo sapiens
acguggggugcgggaagccc

SEQ ID NO: 3628 - RNA, 20 nt, Homo sapiens
cguggggugcgggaagcccc

SEQ ID NO: 3629 - RNA, 20 nt, Homo sapiens
guggggugcgggaagccccg

SEQ ID NO: 3630 - RNA, 20 nt, Homo sapiens
uggggugcgggaagccccgu

SEQ ID NO: 3631 - RNA, 20 nt, Homo sapiens
ggggugcgggaagccccguu

SEQ ID NO: 3632 - RNA, 20 nt, Homo sapiens
gggugcgggaagccccguuc

SEQ ID NO: 3633 - RNA, 20 nt, Homo sapiens
ggugcgggaagccccguucc

SEQ ID NO: 3634 - RNA, 20 nt, Homo sapiens
gugcgggaagccccguuccc

SEQ ID NO: 3635 - RNA, 20 nt, Homo sapiens
ugcgggaagccccguucccc

SEQ ID NO: 3636 - RNA, 20 nt, Homo sapiens
gcgggaagccccguucccca

SEQ ID NO: 3637 - RNA, 20 nt, Homo sapiens
cgggaagccccguuccccac

SEQ ID NO: 3638 - RNA, 20 nt, Homo sapiens
gggaagccccguuccccacg

SEQ ID NO: 3639 - RNA, 20 nt, Homo sapiens
ggaagccccguuccccacgc

SEQ ID NO: 3640 - RNA, 20 nt, Homo sapiens
gaagccccguuccccacgcg

SEQ ID NO: 3641 - RNA, 20 nt, Homo sapiens
aagccccguuccccacgcgc

SEQ ID NO: 3642 - RNA, 20 nt, Homo sapiens
agccccguuccccacgcgcc

SEQ ID NO: 3643 - RNA, 20 nt, Homo sapiens
gccccguuccccacgcgccg

SEQ ID NO: 3644 - RNA, 20 nt, Homo sapiens
ccccguuccccacgcgccgg

SEQ ID NO: 3645 - RNA, 20 nt, Homo sapiens
cccguuccccacgcgccggu

SEQ ID NO: 3646 - RNA, 20 nt, Homo sapiens
ccguuccccacgcgccggug

SEQ ID NO: 3647 - RNA, 20 nt, Homo sapiens
cguuccccacgcgccggugu

SEQ ID NO: 3648 - RNA, 20 nt, Homo sapiens
guuccccacgcgccggugug

SEQ ID NO: 3649 - RNA, 20 nt, Homo sapiens
uuccccacgcgccggugugg

SEQ ID NO: 3650 - RNA, 20 nt, Homo sapiens
uccccacgcgccgguguggg

SEQ ID NO: 3651 - RNA, 20 nt, Homo sapiens
ccccacgcgccggugugggc

SEQ ID NO: 3652 - RNA, 20 nt, Homo sapiens
cccacgcgccggugugggcg

SEQ ID NO: 3653 - RNA, 20 nt, Homo sapiens
ccacgcgccggugugggcga

SEQ ID NO: 3654 - RNA, 20 nt, Homo sapiens
cacgcgccggugugggcgaa

SEQ ID NO: 3655 - RNA, 20 nt, Homo sapiens
acgcgccggugugggcgaag

SEQ ID NO: 3656 - RNA, 20 nt, Homo sapiens
cgcgccggugugggcgaagg

SEQ ID NO: 3657 - RNA, 20 nt, Homo sapiens
gcgccggugugggcgaaggc

SEQ ID NO: 3658 - RNA, 20 nt, Homo sapiens
cgccggugugggcgaaggcg

SEQ ID NO: 3659 - RNA, 20 nt, Homo sapiens
gccggugugggcgaaggcga

SEQ ID NO: 3660 - RNA, 20 nt, Homo sapiens
ccggugugggcgaaggcgac

SEQ ID NO: 3661 - RNA, 20 nt, Homo sapiens
cggugugggcgaaggcgacc

SEQ ID NO: 3662 - RNA, 20 nt, Homo sapiens
ggugugggcgaaggcgaccc

SEQ ID NO: 3663 - RNA, 20 nt, Homo sapiens
gugugggcgaaggcgaccca

SEQ ID NO: 3664 - RNA, 20 nt, Homo sapiens
ugugggcgaaggcgacccac

SEQ ID NO: 3665 - RNA, 20 nt, Homo sapiens
gugggcgaaggcgacccacg

SEQ ID NO: 3666 - RNA, 20 nt, Homo sapiens
ugggcgaaggcgacccacga

SEQ ID NO: 3667 - RNA, 20 nt, Homo sapiens
gggcgaaggcgacccacgag

SEQ ID NO: 3668 - RNA, 20 nt, Homo sapiens
ggcgaaggcgacccacgagg

SEQ ID NO: 3669 - RNA, 20 nt, Homo sapiens
gcgaaggcgacccacgaggg

SEQ ID NO: 3670 - RNA, 20 nt, Homo sapiens
cgaaggcgacccacgaggga

SEQ ID NO: 3671 - RNA, 20 nt, Homo sapiens
gaaggcgacccacgagggag

SEQ ID NO: 3672 - RNA, 20 nt, Homo sapiens
aaggcgacccacgagggagc

SEQ ID NO: 3673 - RNA, 20 nt, Homo sapiens
aggcgacccacgagggagca

SEQ ID NO: 3674 - RNA, 20 nt, Homo sapiens
ggcgacccacgagggagcag

SEQ ID NO: 3675 - RNA, 20 nt, Homo sapiens
gcgacccacgagggagcagg

SEQ ID NO: 3676 - RNA, 20 nt, Homo sapiens
cgacccacgagggagcaggg

SEQ ID NO: 3677 - RNA, 20 nt, Homo sapiens
gacccacgagggagcagggu

SEQ ID NO: 3678 - RNA, 20 nt, Homo sapiens
acccacgagggagcagggug

SEQ ID NO: 3679 - RNA, 20 nt, Homo sapiens
cccacgagggagcaggguga

SEQ ID NO: 3680 - RNA, 20 nt, Homo sapiens
ccacgagggagcagggugac

SEQ ID NO: 3681 - RNA, 20 nt, Homo sapiens
cacgagggagcagggugacc

SEQ ID NO: 3682 - RNA, 20 nt, Homo sapiens
acgagggagcagggugaccc

SEQ ID NO: 3683 - RNA, 20 nt, Homo sapiens
cgagggagcagggugacccc

SEQ ID NO: 3684 - RNA, 20 nt, Homo sapiens
gagggagcagggugaccccc

SEQ ID NO: 3685 - RNA, 20 nt, Homo sapiens
agggagcagggugacccccg

SEQ ID NO: 3686 - RNA, 20 nt, Homo sapiens
gggagcagggugacccccgc

SEQ ID NO: 3687 - RNA, 20 nt, Homo sapiens
ggagcagggugacccccgcc

SEQ ID NO: 3688 - RNA, 20 nt, Homo sapiens
gagcagggugacccccgccg

SEQ ID NO: 3689 - RNA, 20 nt, Homo sapiens
agcagggugacccccgccgg

SEQ ID NO: 3690 - RNA, 20 nt, Homo sapiens
gcagggugacccccgccggg

SEQ ID NO: 3691 - RNA, 20 nt, Homo sapiens
cagggugacccccgccgggg

SEQ ID NO: 3692 - RNA, 20 nt, Homo sapiens
agggugacccccgccggggg

SEQ ID NO: 3693 - RNA, 20 nt, Homo sapiens
gggugacccccgccgggggc

SEQ ID NO: 3694 - RNA, 20 nt, Homo sapiens
ggugacccccgccgggggcc

SEQ ID NO: 3695 - RNA, 20 nt, Homo sapiens
gugacccccgccgggggccg

SEQ ID NO: 3696 - RNA, 20 nt, Homo sapiens
ugacccccgccgggggccgc

SEQ ID NO: 3697 - RNA, 20 nt, Homo sapiens
gacccccgccgggggccgcg

SEQ ID NO: 3698 - RNA, 20 nt, Homo sapiens
acccccgccgggggccgcgc

SEQ ID NO: 3699 - RNA, 20 nt, Homo sapiens
cccccgccgggggccgcgcu

SEQ ID NO: 3700 - RNA, 20 nt, Homo sapiens
ccccgccgggggccgcgcug

SEQ ID NO: 3701 - RNA, 20 nt, Homo sapiens
cccgccgggggccgcgcugc

SEQ ID NO: 3702 - RNA, 20 nt, Homo sapiens
ccgccgggggccgcgcugca

SEQ ID NO: 3703 - RNA, 20 nt, Homo sapiens
cgccgggggccgcgcugcac

SEQ ID NO: 3704 - RNA, 20 nt, Homo sapiens
gccgggggccgcgcugcaca

SEQ ID NO: 3705 - RNA, 20 nt, Homo sapiens
ccgggggccgcgcugcacag

SEQ ID NO: 3706 - RNA, 20 nt, Homo sapiens
cgggggccgcgcugcacagg

SEQ ID NO: 3707 - RNA, 20 nt, Homo sapiens
gggggccgcgcugcacaggc

SEQ ID NO: 3708 - RNA, 20 nt, Homo sapiens
ggggccgcgcugcacaggcc

SEQ ID NO: 3709 - RNA, 20 nt, Homo sapiens
gggccgcgcugcacaggccg

SEQ ID NO: 3710 - RNA, 20 nt, Homo sapiens
ggccgcgcugcacaggccgc

SEQ ID NO: 3711 - RNA, 20 nt, Homo sapiens
gccgcgcugcacaggccgcc

SEQ ID NO: 3712 - RNA, 20 nt, Homo sapiens
ccgcgcugcacaggccgccu

SEQ ID NO: 3713 - RNA, 20 nt, Homo sapiens
cgcgcugcacaggccgccug

SEQ ID NO: 3714 - RNA, 20 nt, Homo sapiens
gcgcugcacaggccgccugc

SEQ ID NO: 3715 - RNA, 20 nt, Homo sapiens
cgcugcacaggccgccugcc

SEQ ID NO: 3716 - RNA, 20 nt, Homo sapiens
gcugcacaggccgccugccu

SEQ ID NO: 3717 - RNA, 20 nt, Homo sapiens
cugcacaggccgccugccug

SEQ ID NO: 3718 - RNA, 20 nt, Homo sapiens
ugcacaggccgccugccugc

SEQ ID NO: 3719 - RNA, 20 nt, Homo sapiens
gcacaggccgccugccugcg

SEQ ID NO: 3720 - RNA, 20 nt, Homo sapiens
cacaggccgccugccugcgc

SEQ ID NO: 3721 - RNA, 20 nt, Homo sapiens
acaggccgccugccugcgcg

SEQ ID NO: 3722 - RNA, 20 nt, Homo sapiens
caggccgccugccugcgcgg

SEQ ID NO: 3723 - RNA, 20 nt, Homo sapiens
aggccgccugccugcgcggg

SEQ ID NO: 3724 - RNA, 20 nt, Homo sapiens
ggccgccugccugcgcgggc

SEQ ID NO: 3725 - RNA, 20 nt, Homo sapiens
gccgccugccugcgcgggcg

SEQ ID NO: 3726 - RNA, 20 nt, Homo sapiens
ccgccugccugcgcgggcgc

SEQ ID NO: 3727 - RNA, 20 nt, Homo sapiens
cgccugccugcgcgggcgcc

SEQ ID NO: 3728 - RNA, 20 nt, Homo sapiens
gccugccugcgcgggcgccc

SEQ ID NO: 3729 - RNA, 20 nt, Homo sapiens
ccugccugcgcgggcgcccu

SEQ ID NO: 3730 - RNA, 20 nt, Homo sapiens
cugccugcgcgggcgcccug

SEQ ID NO: 3731 - RNA, 20 nt, Homo sapiens
ugccugcgcgggcgcccugc

SEQ ID NO: 3732 - RNA, 20 nt, Homo sapiens
gccugcgcgggcgcccugcc

SEQ ID NO: 3733 - RNA, 20 nt, Homo sapiens
ccugcgcgggcgcccugcca

SEQ ID NO: 3734 - RNA, 20 nt, Homo sapiens
cugcgcgggcgcccugccac

SEQ ID NO: 3735 - RNA, 20 nt, Homo sapiens
ugcgcgggcgcccugccacc

SEQ ID NO: 3736 - RNA, 20 nt, Homo sapiens
gcgcgggcgcccugccaccc

SEQ ID NO: 3737 - RNA, 20 nt, Homo sapiens
cgcgggcgcccugccacccu

SEQ ID NO: 3738 - RNA, 20 nt, Homo sapiens
gcgggcgcccugccacccug

SEQ ID NO: 3739 - RNA, 20 nt, Homo sapiens
cgggcgcccugccacccugu

SEQ ID NO: 3740 - RNA, 20 nt, Homo sapiens
gggcgcccugccacccuguc

SEQ ID NO: 3741 - RNA, 20 nt, Homo sapiens
ggcgcccugccacccugucc

SEQ ID NO: 3742 - RNA, 20 nt, Homo sapiens
gcgcccugccacccuguccc

SEQ ID NO: 3743 - RNA, 20 nt, Homo sapiens
cgcccugccacccugucccg

SEQ ID NO: 3744 - RNA, 20 nt, Homo sapiens
gcccugccacccugucccgg

SEQ ID NO: 3745 - RNA, 20 nt, Homo sapiens
cccugccacccugucccggg

SEQ ID NO: 3746 - RNA, 20 nt, Homo sapiens
ccugccacccugucccgggu

SEQ ID NO: 3747 - RNA, 20 nt, Homo sapiens
cugccacccugucccgggug

SEQ ID NO: 3748 - RNA, 20 nt, Homo sapiens
ugccacccugucccgggugc

SEQ ID NO: 3749 - RNA, 20 nt, Homo sapiens
gccacccugucccgggugcc

SEQ ID NO: 3750 - RNA, 20 nt, Homo sapiens
ccacccugucccgggugccu

SEQ ID NO: 3751 - RNA, 20 nt, Homo sapiens
cacccugucccgggugccug

SEQ ID NO: 3752 - RNA, 20 nt, Homo sapiens
acccugucccgggugccugg

SEQ ID NO: 3753 - RNA, 20 nt, Homo sapiens
cccugucccgggugccuggc

SEQ ID NO: 3754 - RNA, 20 nt, Homo sapiens
ccugucccgggugccuggcc

SEQ ID NO: 3755 - RNA, 20 nt, Homo sapiens
cugucccgggugccuggccc

SEQ ID NO: 3756 - RNA, 20 nt, Homo sapiens
ugucccgggugccuggcccu

SEQ ID NO: 3757 - RNA, 20 nt, Homo sapiens
gucccgggugccuggcccuu

SEQ ID NO: 3758 - RNA, 20 nt, Homo sapiens
ucccgggugccuggcccuuc

SEQ ID NO: 3759 - RNA, 20 nt, Homo sapiens
cccgggugccuggcccuucg

SEQ ID NO: 3760 - RNA, 20 nt, Homo sapiens
ccgggugccuggcccuucga

SEQ ID NO: 3761 - RNA, 20 nt, Homo sapiens
cgggugccuggcccuucgau

SEQ ID NO: 3762 - RNA, 20 nt, Homo sapiens
gggugccuggcccuucgauu

SEQ ID NO: 3763 - RNA, 20 nt, Homo sapiens
ggugccuggcccuucgauuc

SEQ ID NO: 3764 - RNA, 20 nt, Homo sapiens
gugccuggcccuucgauucu

SEQ ID NO: 3765 - RNA, 20 nt, Homo sapiens
ugccuggcccuucgauucug

SEQ ID NO: 3766 - RNA, 20 nt, Homo sapiens
gccuggcccuucgauucuga

SEQ ID NO: 3767 - RNA, 20 nt, Homo sapiens
ccuggcccuucgauucugaa

SEQ ID NO: 3768 - RNA, 20 nt, Homo sapiens
cuggcccuucgauucugaaa

SEQ ID NO: 3769 - RNA, 20 nt, Homo sapiens
uggcccuucgauucugaaac

SEQ ID NO: 3770 - RNA, 20 nt, Homo sapiens
ggcccuucgauucugaaacc

SEQ ID NO: 3771 - RNA, 20 nt, Homo sapiens
gcccuucgauucugaaacca

SEQ ID NO: 3772 - RNA, 20 nt, Homo sapiens
cccuucgauucugaaaccag

SEQ ID NO: 3773 - RNA, 20 nt, Homo sapiens
ccuucgauucugaaaccaga

SEQ ID NO: 3774 - RNA, 20 nt, Homo sapiens
cuucgauucugaaaccagau

SEQ ID NO: 3775 - RNA, 20 nt, Homo sapiens
uucgauucugaaaccagauc

SEQ ID NO: 3776 - RNA, 20 nt, Homo sapiens
ucgauucugaaaccagaucu

SEQ ID NO: 3777 - RNA, 20 nt, Homo sapiens
cgauucugaaaccagaucug

SEQ ID NO: 3778 - RNA, 20 nt, Homo sapiens
gauucugaaaccagaucuga

SEQ ID NO: 3779 - RNA, 20 nt, Homo sapiens
auucugaaaccagaucugaa

SEQ ID NO: 3780 - RNA, 20 nt, Homo sapiens
uucugaaaccagaucugaau

SEQ ID NO: 3781 - RNA, 20 nt, Homo sapiens
ucugaaaccagaucugaauc

SEQ ID NO: 3782 - RNA, 20 nt, Homo sapiens
cugaaaccagaucugaaucc

SEQ ID NO: 3783 - RNA, 20 nt, Homo sapiens
ugaaaccagaucugaauccu

SEQ ID NO: 3784 - RNA, 20 nt, Homo sapiens
gaaaccagaucugaauccug

SEQ ID NO: 3785 - RNA, 20 nt, Homo sapiens
aaaccagaucugaauccugg

SEQ ID NO: 3786 - RNA, 20 nt, Homo sapiens
aaccagaucugaauccugga

SEQ ID NO: 3787 - RNA, 20 nt, Homo sapiens
accagaucugaauccuggac

SEQ ID NO: 3788 - RNA, 20 nt, Homo sapiens
ccagaucugaauccuggacu

SEQ ID NO: 3789 - RNA, 20 nt, Homo sapiens
cagaucugaauccuggacuc

SEQ ID NO: 3790 - RNA, 20 nt, Homo sapiens
agaucugaauccuggacucc

SEQ ID NO: 3791 - RNA, 20 nt, Homo sapiens
gaucugaauccuggacuccg

SEQ ID NO: 3792 - RNA, 20 nt, Homo sapiens
aucugaauccuggacuccgg

SEQ ID NO: 3793 - RNA, 20 nt, Homo sapiens
ucugaauccuggacuccggg

SEQ ID NO: 3794 - RNA, 20 nt, Homo sapiens
cugaauccuggacuccggga

SEQ ID NO: 3795 - RNA, 20 nt, Homo sapiens
ugaauccuggacuccgggag

SEQ ID NO: 3796 - RNA, 20 nt, Homo sapiens
gaauccuggacuccgggagg

SEQ ID NO: 3797 - RNA, 20 nt, Homo sapiens
aauccuggacuccgggaggc

SEQ ID NO: 3798 - RNA, 20 nt, Homo sapiens
auccuggacuccgggaggcc

SEQ ID NO: 3799 - RNA, 20 nt, Homo sapiens
uccuggacuccgggaggccc

SEQ ID NO: 3800 - RNA, 20 nt, Homo sapiens
ccuggacuccgggaggcccg

SEQ ID NO: 3801 - RNA, 20 nt, Homo sapiens
cuggacuccgggaggcccgu

SEQ ID NO: 3802 - RNA, 20 nt, Homo sapiens
uggacuccgggaggcccguc

SEQ ID NO: 3803 - RNA, 20 nt, Homo sapiens
ggacuccgggaggcccgucu

SEQ ID NO: 3804 - RNA, 20 nt, Homo sapiens
gacuccgggaggcccgucuc

SEQ ID NO: 3805 - RNA, 20 nt, Homo sapiens
acuccgggaggcccgucucu

SEQ ID NO: 3806 - RNA, 20 nt, Homo sapiens
cuccgggaggcccgucucuc

SEQ ID NO: 3807 - RNA, 20 nt, Homo sapiens
uccgggaggcccgucucucu

SEQ ID NO: 3808 - RNA, 20 nt, Homo sapiens
ccgggaggcccgucucucug

SEQ ID NO: 3809 - RNA, 20 nt, Homo sapiens
cgggaggcccgucucucugg

SEQ ID NO: 3810 - RNA, 20 nt, Homo sapiens
gggaggcccgucucucuggc

SEQ ID NO: 3811 - RNA, 20 nt, Homo sapiens
ggaggcccgucucucuggcc

SEQ ID NO: 3812 - RNA, 20 nt, Homo sapiens
gaggcccgucucucuggcca

SEQ ID NO: 3813 - RNA, 20 nt, Homo sapiens
aggcccgucucucuggccag

SEQ ID NO: 3814 - RNA, 20 nt, Homo sapiens
ggcccgucucucuggccagc

SEQ ID NO: 3815 - RNA, 20 nt, Homo sapiens
gcccgucucucuggccagcu

SEQ ID NO: 3816 - RNA, 20 nt, Homo sapiens
cccgucucucuggccagcuc

SEQ ID NO: 3817 - RNA, 20 nt, Homo sapiens
ccgucucucuggccagcucc

SEQ ID NO: 3818 - RNA, 20 nt, Homo sapiens
cgucucucuggccagcuccu

SEQ ID NO: 3819 - RNA, 20 nt, Homo sapiens
gucucucuggccagcuccuc

SEQ ID NO: 3820 - RNA, 20 nt, Homo sapiens
ucucucuggccagcuccucc

SEQ ID NO: 3821 - RNA, 20 nt, Homo sapiens
cucucuggccagcuccuccc

SEQ ID NO: 3822 - RNA, 20 nt, Homo sapiens
ucucuggccagcuccucccg

SEQ ID NO: 3823 - RNA, 20 nt, Homo sapiens
cucuggccagcuccucccgg

SEQ ID NO: 3824 - RNA, 20 nt, Homo sapiens
ucuggccagcuccucccggg

SEQ ID NO: 3825 - RNA, 20 nt, Homo sapiens
cuggccagcuccucccgggc

SEQ ID NO: 3826 - RNA, 20 nt, Homo sapiens
uggccagcuccucccgggcg

SEQ ID NO: 3827 - RNA, 20 nt, Homo sapiens
ggccagcuccucccgggcgg

SEQ ID NO: 3828 - RNA, 20 nt, Homo sapiens
gccagcuccucccgggcggc

SEQ ID NO: 3829 - RNA, 20 nt, Homo sapiens
ccagcuccucccgggcggcg

SEQ ID NO: 3830 - RNA, 20 nt, Homo sapiens
cagcuccucccgggcggcga

SEQ ID NO: 3831 - RNA, 20 nt, Homo sapiens
agcuccucccgggcggcgau

SEQ ID NO: 3832 - RNA, 20 nt, Homo sapiens
gcuccucccgggcggcgaug

SEQ ID NO: 3833 - RNA, 20 nt, Homo sapiens
cuccucccgggcggcgaugc

SEQ ID NO: 3834 - RNA, 20 nt, Homo sapiens
uccucccgggcggcgaugcc

SEQ ID NO: 3835 - RNA, 20 nt, Homo sapiens
ccucccgggcggcgaugccu

SEQ ID NO: 3836 - RNA, 20 nt, Homo sapiens
cucccgggcggcgaugccug

SEQ ID NO: 3837 - RNA, 20 nt, Homo sapiens
ucccgggcggcgaugccugg

SEQ ID NO: 3838 - RNA, 20 nt, Homo sapiens
cccgggcggcgaugccugga

SEQ ID NO: 3839 - RNA, 20 nt, Homo sapiens
ccgggcggcgaugccuggaa

SEQ ID NO: 3840 - RNA, 20 nt, Homo sapiens
cgggcggcgaugccuggaaa

SEQ ID NO: 3841 - RNA, 20 nt, Homo sapiens
gggcggcgaugccuggaaag

SEQ ID NO: 3842 - RNA, 20 nt, Homo sapiens
ggcggcgaugccuggaaagc

SEQ ID NO: 3843 - RNA, 20 nt, Homo sapiens
gcggcgaugccuggaaagcg

SEQ ID NO: 3844 - RNA, 20 nt, Homo sapiens
cggcgaugccuggaaagcga

SEQ ID NO: 3845 - RNA, 20 nt, Homo sapiens
ggcgaugccuggaaagcgau

SEQ ID NO: 3846 - RNA, 20 nt, Homo sapiens
gcgaugccuggaaagcgauc

SEQ ID NO: 3847 - RNA, 20 nt, Homo sapiens
cgaugccuggaaagcgaucc

SEQ ID NO: 3848 - RNA, 20 nt, Homo sapiens
gaugccuggaaagcgauccu

SEQ ID NO: 3849 - RNA, 20 nt, Homo sapiens
augccuggaaagcgauccuu

SEQ ID NO: 3850 - RNA, 20 nt, Homo sapiens
ugccuggaaagcgauccuuc

SEQ ID NO: 3851 - RNA, 20 nt, Homo sapiens
gccuggaaagcgauccuucu

SEQ ID NO: 3852 - RNA, 20 nt, Homo sapiens
ccuggaaagcgauccuucuc

SEQ ID NO: 3853 - RNA, 20 nt, Homo sapiens
cuggaaagcgauccuucuca

SEQ ID NO: 3854 - RNA, 20 nt, Homo sapiens
uggaaagcgauccuucucaa

SEQ ID NO: 3855 - RNA, 20 nt, Homo sapiens
ggaaagcgauccuucucaaa

SEQ ID NO: 3856 - RNA, 20 nt, Homo sapiens
gaaagcgauccuucucaaag

SEQ ID NO: 3857 - RNA, 20 nt, Homo sapiens
aaagcgauccuucucaaagg

SEQ ID NO: 3858 - RNA, 20 nt, Homo sapiens
aagcgauccuucucaaaggc

SEQ ID NO: 3859 - RNA, 20 nt, Homo sapiens
agcgauccuucucaaaggcu

SEQ ID NO: 3860 - RNA, 20 nt, Homo sapiens
gcgauccuucucaaaggcuc

SEQ ID NO: 3861 - RNA, 20 nt, Homo sapiens
cgauccuucucaaaggcucg

SEQ ID NO: 3862 - RNA, 20 nt, Homo sapiens
gauccuucucaaaggcucgg

SEQ ID NO: 3863 - RNA, 20 nt, Homo sapiens
auccuucucaaaggcucgga

SEQ ID NO: 3864 - RNA, 20 nt, Homo sapiens
uccuucucaaaggcucggag

SEQ ID NO: 3865 - RNA, 20 nt, Homo sapiens
ccuucucaaaggcucggagg

SEQ ID NO: 3866 - RNA, 20 nt, Homo sapiens
cuucucaaaggcucggagga

SEQ ID NO: 3867 - RNA, 20 nt, Homo sapiens
uucucaaaggcucggaggag

SEQ ID NO: 3868 - RNA, 20 nt, Homo sapiens
ucucaaaggcucggaggagc

SEQ ID NO: 3869 - RNA, 20 nt, Homo sapiens
cucaaaggcucggaggagca

SEQ ID NO: 3870 - RNA, 20 nt, Homo sapiens
ucaaaggcucggaggagcag

SEQ ID NO: 3871 - RNA, 20 nt, Homo sapiens
caaaggcucggaggagcagg

SEQ ID NO: 3872 - RNA, 20 nt, Homo sapiens
aaaggcucggaggagcaggg

SEQ ID NO: 3873 - RNA, 20 nt, Homo sapiens
aaggcucggaggagcagggc

SEQ ID NO: 3874 - RNA, 20 nt, Homo sapiens
aggcucggaggagcagggcg

SEQ ID NO: 3875 - RNA, 20 nt, Homo sapiens
ggcucggaggagcagggcgg

SEQ ID NO: 3876 - RNA, 20 nt, Homo sapiens
gcucggaggagcagggcggu

SEQ ID NO: 3877 - RNA, 20 nt, Homo sapiens
cucggaggagcagggcgguc

SEQ ID NO: 3878 - RNA, 20 nt, Homo sapiens
ucggaggagcagggcggucu

SEQ ID NO: 3879 - RNA, 20 nt, Homo sapiens
cggaggagcagggcggucug

SEQ ID NO: 3880 - RNA, 20 nt, Homo sapiens
ggaggagcagggcggucugg

SEQ ID NO: 3881 - RNA, 20 nt, Homo sapiens
gaggagcagggcggucuggg

SEQ ID NO: 3882 - RNA, 20 nt, Homo sapiens
aggagcagggcggucuggga

SEQ ID NO: 3883 - RNA, 20 nt, Homo sapiens
ggagcagggcggucugggau

SEQ ID NO: 3884 - RNA, 20 nt, Homo sapiens
gagcagggcggucugggauc

SEQ ID NO: 3885 - RNA, 20 nt, Homo sapiens
agcagggcggucugggaucc

SEQ ID NO: 3886 - RNA, 20 nt, Homo sapiens
gcagggcggucugggauccg

SEQ ID NO: 3887 - RNA, 20 nt, Homo sapiens
cagggcggucugggauccgg

SEQ ID NO: 3888 - RNA, 20 nt, Homo sapiens
agggcggucugggauccggu

SEQ ID NO: 3889 - RNA, 20 nt, Homo sapiens
gggcggucugggauccggug

SEQ ID NO: 3890 - RNA, 20 nt, Homo sapiens
ggcggucugggauccgguga

SEQ ID NO: 3891 - RNA, 20 nt, Homo sapiens
gcggucugggauccggugac

SEQ ID NO: 3892 - RNA, 20 nt, Homo sapiens
cggucugggauccggugacg

SEQ ID NO: 3893 - RNA, 20 nt, Homo sapiens
ggucugggauccggugacgg

SEQ ID NO: 3894 - RNA, 20 nt, Homo sapiens
gucugggauccggugacggc

SEQ ID NO: 3895 - RNA, 20 nt, Homo sapiens
ucugggauccggugacggcg

SEQ ID NO: 3896 - RNA, 20 nt, Homo sapiens
cugggauccggugacggcgg

SEQ ID NO: 3897 - RNA, 20 nt, Homo sapiens
ugggauccggugacggcggu

SEQ ID NO: 3898 - RNA, 20 nt, Homo sapiens
gggauccggugacggcgguc

SEQ ID NO: 3899 - RNA, 20 nt, Homo sapiens
ggauccggugacggcggucc

SEQ ID NO: 3900 - RNA, 20 nt, Homo sapiens
gauccggugacggcgguccg

SEQ ID NO: 3901 - RNA, 20 nt, Homo sapiens
auccggugacggcgguccgc

SEQ ID NO: 3902 - RNA, 20 nt, Homo sapiens
uccggugacggcgguccgcu

SEQ ID NO: 3903 - RNA, 20 nt, Homo sapiens
ccggugacggcgguccgcuu

SEQ ID NO: 3904 - RNA, 20 nt, Homo sapiens
cggugacggcgguccgcuuu

SEQ ID NO: 3905 - RNA, 20 nt, Homo sapiens
ggugacggcgguccgcuuuc

SEQ ID NO: 3906 - RNA, 20 nt, Homo sapiens
gugacggcgguccgcuuucg

SEQ ID NO: 3907 - RNA, 20 nt, Homo sapiens
ugacggcgguccgcuuucgc

SEQ ID NO: 3908 - RNA, 20 nt, Homo sapiens
gacggcgguccgcuuucgcc

SEQ ID NO: 3909 - RNA, 20 nt, Homo sapiens
acggcgguccgcuuucgccg

SEQ ID NO: 3910 - RNA, 20 nt, Homo sapiens
cggcgguccgcuuucgccgg

SEQ ID NO: 3911 - RNA, 20 nt, Homo sapiens
ggcgguccgcuuucgccggc

SEQ ID NO: 3912 - RNA, 20 nt, Homo sapiens
gcgguccgcuuucgccggcc

SEQ ID NO: 3913 - RNA, 20 nt, Homo sapiens
cgguccgcuuucgccggccu

SEQ ID NO: 3914 - RNA, 20 nt, Homo sapiens
gguccgcuuucgccggccuu

SEQ ID NO: 3915 - RNA, 20 nt, Homo sapiens
guccgcuuucgccggccuuc

SEQ ID NO: 3916 - RNA, 20 nt, Homo sapiens
uccgcuuucgccggccuucu

SEQ ID NO: 3917 - RNA, 20 nt, Homo sapiens
ccgcuuucgccggccuucug

SEQ ID NO: 3918 - RNA, 20 nt, Homo sapiens
cgcuuucgccggccuucugg

SEQ ID NO: 3919 - RNA, 20 nt, Homo sapiens
gcuuucgccggccuucuggc

SEQ ID NO: 3920 - RNA, 20 nt, Homo sapiens
cuuucgccggccuucuggcg

SEQ ID NO: 3921 - RNA, 20 nt, Homo sapiens
uuucgccggccuucuggcgg

SEQ ID NO: 3922 - RNA, 20 nt, Homo sapiens
uucgccggccuucuggcggg

SEQ ID NO: 3923 - RNA, 20 nt, Homo sapiens
ucgccggccuucuggcgggc

SEQ ID NO: 3924 - RNA, 20 nt, Homo sapiens
cgccggccuucuggcgggcc

SEQ ID NO: 3925 - RNA, 20 nt, Homo sapiens
gccggccuucuggcgggccg

SEQ ID NO: 3926 - RNA, 20 nt, Homo sapiens
ccggccuucuggcgggccgc

SEQ ID NO: 3927 - RNA, 20 nt, Homo sapiens
cggccuucuggcgggccgcg

SEQ ID NO: 3928 - RNA, 20 nt, Homo sapiens
ggccuucuggcgggccgcgu

SEQ ID NO: 3929 - RNA, 20 nt, Homo sapiens
gccuucuggcgggccgcguc

SEQ ID NO: 3930 - RNA, 20 nt, Homo sapiens
ccuucuggcgggccgcgucu

SEQ ID NO: 3931 - RNA, 20 nt, Homo sapiens
cuucuggcgggccgcgucuc

SEQ ID NO: 3932 - RNA, 20 nt, Homo sapiens
uucuggcgggccgcgucucc

SEQ ID NO: 3933 - RNA, 20 nt, Homo sapiens
ucuggcgggccgcgucuccc

SEQ ID NO: 3934 - RNA, 20 nt, Homo sapiens
cuggcgggccgcgucucccg

SEQ ID NO: 3935 - RNA, 20 nt, Homo sapiens
uggcgggccgcgucucccgg

SEQ ID NO: 3936 - RNA, 20 nt, Homo sapiens
ggcgggccgcgucucccggg

SEQ ID NO: 3937 - RNA, 20 nt, Homo sapiens
gcgggccgcgucucccgggc

SEQ ID NO: 3938 - RNA, 20 nt, Homo sapiens
cgggccgcgucucccgggcc

SEQ ID NO: 3939 - RNA, 20 nt, Homo sapiens
gggccgcgucucccgggcca

SEQ ID NO: 3940 - RNA, 20 nt, Homo sapiens
ggccgcgucucccgggccag

SEQ ID NO: 3941 - RNA, 20 nt, Homo sapiens
gccgcgucucccgggccagg

SEQ ID NO: 3942 - RNA, 20 nt, Homo sapiens
ccgcgucucccgggccaggg

SEQ ID NO: 3943 - RNA, 20 nt, Homo sapiens
cgcgucucccgggccagggc

SEQ ID NO: 3944 - RNA, 20 nt, Homo sapiens
gcgucucccgggccagggcc

SEQ ID NO: 3945 - RNA, 20 nt, Homo sapiens
cgucucccgggccagggccg

SEQ ID NO: 3946 - RNA, 20 nt, Homo sapiens
gucucccgggccagggccga

SEQ ID NO: 3947 - RNA, 20 nt, Homo sapiens
ucucccgggccagggccgag

SEQ ID NO: 3948 - RNA, 20 nt, Homo sapiens
cucccgggccagggccgaga

SEQ ID NO: 3949 - RNA, 20 nt, Homo sapiens
ucccgggccagggccgagau

SEQ ID NO: 3950 - RNA, 20 nt, Homo sapiens
cccgggccagggccgagauu

SEQ ID NO: 3951 - RNA, 20 nt, Homo sapiens
ccgggccagggccgagauuc

SEQ ID NO: 3952 - RNA, 20 nt, Homo sapiens
cgggccagggccgagauucc

SEQ ID NO: 3953 - RNA, 20 nt, Homo sapiens
gggccagggccgagauuccc

SEQ ID NO: 3954 - RNA, 20 nt, Homo sapiens
ggccagggccgagauucccg

SEQ ID NO: 3955 - RNA, 20 nt, Homo sapiens
gccagggccgagauucccgc

SEQ ID NO: 3956 - RNA, 20 nt, Homo sapiens
ccagggccgagauucccgcc

SEQ ID NO: 3957 - RNA, 20 nt, Homo sapiens
cagggccgagauucccgccg

SEQ ID NO: 3958 - RNA, 20 nt, Homo sapiens
agggccgagauucccgccgg

SEQ ID NO: 3959 - RNA, 20 nt, Homo sapiens
gggccgagauucccgccggu

SEQ ID NO: 3960 - RNA, 20 nt, Homo sapiens
ggccgagauucccgccggug

SEQ ID NO: 3961 - RNA, 20 nt, Homo sapiens
gccgagauucccgccggugc

SEQ ID NO: 3962 - RNA, 20 nt, Homo sapiens
ccgagauucccgccggugcu

SEQ ID NO: 3963 - RNA, 20 nt, Homo sapiens
cgagauucccgccggugcug

SEQ ID NO: 3964 - RNA, 20 nt, Homo sapiens
gagauucccgccggugcugc

SEQ ID NO: 3965 - RNA, 20 nt, Homo sapiens
agauucccgccggugcugcc

SEQ ID NO: 3966 - RNA, 20 nt, Homo sapiens
gauucccgccggugcugccu

SEQ ID NO: 3967 - RNA, 20 nt, Homo sapiens
auucccgccggugcugccuc

SEQ ID NO: 3968 - RNA, 20 nt, Homo sapiens
uucccgccggugcugccuca

SEQ ID NO: 3969 - RNA, 20 nt, Homo sapiens
ucccgccggugcugccucag

SEQ ID NO: 3970 - RNA, 20 nt, Homo sapiens
cccgccggugcugccucagc

SEQ ID NO: 3971 - RNA, 20 nt, Homo sapiens
ccgccggugcugccucagcu

SEQ ID NO: 3972 - RNA, 20 nt, Homo sapiens
cgccggugcugccucagcug

SEQ ID NO: 3973 - RNA, 20 nt, Homo sapiens
gccggugcugccucagcugg

SEQ ID NO: 3974 - RNA, 20 nt, Homo sapiens
ccggugcugccucagcuggc

SEQ ID NO: 3975 - RNA, 20 nt, Homo sapiens
cggugcugccucagcuggcg

SEQ ID NO: 3976 - RNA, 20 nt, Homo sapiens
ggugcugccucagcuggcgu

SEQ ID NO: 3977 - RNA, 20 nt, Homo sapiens
gugcugccucagcuggcgug

SEQ ID NO: 3978 - RNA, 20 nt, Homo sapiens
ugcugccucagcuggcguga

SEQ ID NO: 3979 - RNA, 20 nt, Homo sapiens
gcugccucagcuggcgugac

SEQ ID NO: 3980 - RNA, 20 nt, Homo sapiens
cugccucagcuggcgugacc

SEQ ID NO: 3981 - RNA, 20 nt, Homo sapiens
ugccucagcuggcgugaccu

SEQ ID NO: 3982 - RNA, 20 nt, Homo sapiens
gccucagcuggcgugaccuc

SEQ ID NO: 3983 - RNA, 20 nt, Homo sapiens
ccucagcuggcgugaccucu

SEQ ID NO: 3984 - RNA, 20 nt, Homo sapiens
cucagcuggcgugaccucuc

SEQ ID NO: 3985 - RNA, 20 nt, Homo sapiens
ucagcuggcgugaccucuca

SEQ ID NO: 3986 - RNA, 20 nt, Homo sapiens
cagcuggcgugaccucucau

SEQ ID NO: 3987 - RNA, 20 nt, Homo sapiens
agcuggcgugaccucucauu

SEQ ID NO: 3988 - RNA, 20 nt, Homo sapiens
gcuggcgugaccucucauuc

SEQ ID NO: 3989 - RNA, 20 nt, Homo sapiens
cuggcgugaccucucauucu

SEQ ID NO: 3990 - RNA, 20 nt, Homo sapiens
uggcgugaccucucauucug

SEQ ID NO: 3991 - RNA, 20 nt, Homo sapiens
ggcgugaccucucauucuga

SEQ ID NO: 3992 - RNA, 20 nt, Homo sapiens
gcgugaccucucauucugaa

SEQ ID NO: 3993 - RNA, 20 nt, Homo sapiens
cgugaccucucauucugaaa

SEQ ID NO: 3994 - RNA, 20 nt, Homo sapiens
gugaccucucauucugaaac

SEQ ID NO: 3995 - RNA, 20 nt, Homo sapiens
ugaccucucauucugaaacc

SEQ ID NO: 3996 - RNA, 20 nt, Homo sapiens
gaccucucauucugaaacca

SEQ ID NO: 3997 - RNA, 20 nt, Homo sapiens
accucucauucugaaaccaa

SEQ ID NO: 3998 - RNA, 20 nt, Homo sapiens
ccucucauucugaaaccaaa

SEQ ID NO: 3999 - RNA, 20 nt, Homo sapiens
cucucauucugaaaccaaau

SEQ ID NO: 4000 - RNA, 20 nt, Homo sapiens
ucucauucugaaaccaaauc

SEQ ID NO: 4001 - RNA, 20 nt, Homo sapiens
cucauucugaaaccaaaucu

SEQ ID NO: 4002 - RNA, 20 nt, Homo sapiens
ucauucugaaaccaaaucug

SEQ ID NO: 4003 - RNA, 20 nt, Homo sapiens
cauucugaaaccaaaucugg

SEQ ID NO: 4004 - RNA, 20 nt, Homo sapiens
auucugaaaccaaaucugga

SEQ ID NO: 4005 - RNA, 20 nt, Homo sapiens
uucugaaaccaaaucuggac

SEQ ID NO: 4006 - RNA, 20 nt, Homo sapiens
ucugaaaccaaaucuggacc

SEQ ID NO: 4007 - RNA, 20 nt, Homo sapiens
cugaaaccaaaucuggaccc

SEQ ID NO: 4008 - RNA, 20 nt, Homo sapiens
ugaaaccaaaucuggacccu

SEQ ID NO: 4009 - RNA, 20 nt, Homo sapiens
gaaaccaaaucuggacccug

SEQ ID NO: 4010 - RNA, 20 nt, Homo sapiens
aaaccaaaucuggacccugg

SEQ ID NO: 4011 - RNA, 20 nt, Homo sapiens
aaccaaaucuggacccuggg

SEQ ID NO: 4012 - RNA, 20 nt, Homo sapiens
accaaaucuggacccugggc

SEQ ID NO: 4013 - RNA, 20 nt, Homo sapiens
ccaaaucuggacccugggcu

SEQ ID NO: 4014 - RNA, 20 nt, Homo sapiens
caaaucuggacccugggcuc

SEQ ID NO: 4015 - RNA, 20 nt, Homo sapiens
aaaucuggacccugggcucc

SEQ ID NO: 4016 - RNA, 20 nt, Homo sapiens
aaucuggacccugggcuccg

SEQ ID NO: 4017 - RNA, 20 nt, Homo sapiens
aucuggacccugggcuccgg

SEQ ID NO: 4018 - RNA, 20 nt, Homo sapiens
ucuggacccugggcuccgga

SEQ ID NO: 4019 - RNA, 20 nt, Homo sapiens
cuggacccugggcuccggaa

SEQ ID NO: 4020 - RNA, 20 nt, Homo sapiens
uggacccugggcuccggaau

SEQ ID NO: 4021 - RNA, 20 nt, Homo sapiens
ggacccugggcuccggaaug

SEQ ID NO: 4022 - RNA, 20 nt, Homo sapiens
gacccugggcuccggaaugc

SEQ ID NO: 4023 - RNA, 20 nt, Homo sapiens
acccugggcuccggaaugcc

SEQ ID NO: 4024 - RNA, 20 nt, Homo sapiens
cccugggcuccggaaugccg

SEQ ID NO: 4025 - RNA, 20 nt, Homo sapiens
ccugggcuccggaaugccga

SEQ ID NO: 4026 - RNA, 20 nt, Homo sapiens
cugggcuccggaaugccgau

SEQ ID NO: 4027 - RNA, 20 nt, Homo sapiens
ugggcuccggaaugccgaug

SEQ ID NO: 4028 - RNA, 20 nt, Homo sapiens
gggcuccggaaugccgaugg

SEQ ID NO: 4029 - RNA, 20 nt, Homo sapiens
ggcuccggaaugccgauggc

SEQ ID NO: 4030 - RNA, 20 nt, Homo sapiens
gcuccggaaugccgauggcc

SEQ ID NO: 4031 - RNA, 20 nt, Homo sapiens
cuccggaaugccgauggccu

SEQ ID NO: 4032 - RNA, 20 nt, Homo sapiens
uccggaaugccgauggccug

SEQ ID NO: 4033 - RNA, 20 nt, Homo sapiens
ccggaaugccgauggccugg

SEQ ID NO: 4034 - RNA, 20 nt, Homo sapiens
cggaaugccgauggccuggg

SEQ ID NO: 4035 - RNA, 20 nt, Homo sapiens
ggaaugccgauggccugggc

SEQ ID NO: 4036 - RNA, 20 nt, Homo sapiens
gaaugccgauggccugggcc

SEQ ID NO: 4037 - RNA, 20 nt, Homo sapiens
aaugccgauggccugggcca

SEQ ID NO: 4038 - RNA, 20 nt, Homo sapiens
augccgauggccugggccag

SEQ ID NO: 4039 - RNA, 20 nt, Homo sapiens
ugccgauggccugggccagc

SEQ ID NO: 4040 - RNA, 20 nt, Homo sapiens
gccgauggccugggccagcc

SEQ ID NO: 4041 - RNA, 20 nt, Homo sapiens
ccgauggccugggccagccg

SEQ ID NO: 4042 - RNA, 20 nt, Homo sapiens
cgauggccugggccagccgu

SEQ ID NO: 4043 - RNA, 20 nt, Homo sapiens
gauggccugggccagccguu

SEQ ID NO: 4044 - RNA, 20 nt, Homo sapiens
auggccugggccagccguuc

SEQ ID NO: 4045 - RNA, 20 nt, Homo sapiens
uggccugggccagccguucu

SEQ ID NO: 4046 - RNA, 20 nt, Homo sapiens
ggccugggccagccguucuc

SEQ ID NO: 4047 - RNA, 20 nt, Homo sapiens
gccugggccagccguucucu

SEQ ID NO: 4048 - RNA, 20 nt, Homo sapiens
ccugggccagccguucucug

SEQ ID NO: 4049 - RNA, 20 nt, Homo sapiens
cugggccagccguucucugg

SEQ ID NO: 4050 - RNA, 20 nt, Homo sapiens
ugggccagccguucucuggu

SEQ ID NO: 4051 - RNA, 20 nt, Homo sapiens
gggccagccguucucuggug

SEQ ID NO: 4052 - RNA, 20 nt, Homo sapiens
ggccagccguucucuggugg

SEQ ID NO: 4053 - RNA, 20 nt, Homo sapiens
gccagccguucucugguggc

SEQ ID NO: 4054 - RNA, 20 nt, Homo sapiens
ccagccguucucugguggcg

SEQ ID NO: 4055 - RNA, 20 nt, Homo sapiens
cagccguucucugguggcga

SEQ ID NO: 4056 - RNA, 20 nt, Homo sapiens
agccguucucugguggcgau

SEQ ID NO: 4057 - RNA, 20 nt, Homo sapiens
gccguucucugguggcgaug

SEQ ID NO: 4058 - RNA, 20 nt, Homo sapiens
ccguucucugguggcgaugc

SEQ ID NO: 4059 - RNA, 20 nt, Homo sapiens
cguucucugguggcgaugcc

SEQ ID NO: 4060 - RNA, 20 nt, Homo sapiens
guucucugguggcgaugccc

SEQ ID NO: 4061 - RNA, 20 nt, Homo sapiens
uucucugguggcgaugcccg

SEQ ID NO: 4062 - RNA, 20 nt, Homo sapiens
ucucugguggcgaugcccgg

SEQ ID NO: 4063 - RNA, 20 nt, Homo sapiens
cucugguggcgaugcccggg

SEQ ID NO: 4064 - RNA, 20 nt, Homo sapiens
ucugguggcgaugcccgggu

SEQ ID NO: 4065 - RNA, 20 nt, Homo sapiens
cugguggcgaugcccgggua

SEQ ID NO: 4066 - RNA, 20 nt, Homo sapiens
ugguggcgaugcccggguac

SEQ ID NO: 4067 - RNA, 20 nt, Homo sapiens
gguggcgaugcccggguacg

SEQ ID NO: 4068 - RNA, 20 nt, Homo sapiens
guggcgaugcccggguacgg

SEQ ID NO: 4069 - RNA, 20 nt, Homo sapiens
uggcgaugcccggguacggg

SEQ ID NO: 4070 - RNA, 20 nt, Homo sapiens
ggcgaugcccggguacgggu

SEQ ID NO: 4071 - RNA, 20 nt, Homo sapiens
gcgaugcccggguacggguu

SEQ ID NO: 4072 - RNA, 20 nt, Homo sapiens
cgaugcccggguacggguuc

SEQ ID NO: 4073 - RNA, 20 nt, Homo sapiens
gaugcccggguacggguucc

SEQ ID NO: 4074 - RNA, 20 nt, Homo sapiens
augcccggguacggguuccg

SEQ ID NO: 4075 - RNA, 20 nt, Homo sapiens
ugcccggguacggguuccgc

SEQ ID NO: 4076 - RNA, 20 nt, Homo sapiens
gcccggguacggguuccgcu

SEQ ID NO: 4077 - RNA, 20 nt, Homo sapiens
cccggguacggguuccgcuc

SEQ ID NO: 4078 - RNA, 20 nt, Homo sapiens
ccggguacggguuccgcuca

SEQ ID NO: 4079 - RNA, 20 nt, Homo sapiens
cggguacggguuccgcucaa

SEQ ID NO: 4080 - RNA, 20 nt, Homo sapiens
ggguacggguuccgcucaaa

SEQ ID NO: 4081 - RNA, 20 nt, Homo sapiens
gguacggguuccgcucaaag

SEQ ID NO: 4082 - RNA, 20 nt, Homo sapiens
guacggguuccgcucaaagc

SEQ ID NO: 4083 - RNA, 20 nt, Homo sapiens
uacggguuccgcucaaagca

SEQ ID NO: 4084 - RNA, 20 nt, Homo sapiens
acggguuccgcucaaagcag

SEQ ID NO: 4085 - RNA, 20 nt, Homo sapiens
cggguuccgcucaaagcagg

SEQ ID NO: 4086 - RNA, 20 nt, Homo sapiens
ggguuccgcucaaagcaggc

SEQ ID NO: 4087 - RNA, 20 nt, Homo sapiens
gguuccgcucaaagcaggcu

SEQ ID NO: 4088 - RNA, 20 nt, Homo sapiens
guuccgcucaaagcaggcuc

SEQ ID NO: 4089 - RNA, 20 nt, Homo sapiens
uuccgcucaaagcaggcucg

SEQ ID NO: 4090 - RNA, 20 nt, Homo sapiens
uccgcucaaagcaggcucgc

SEQ ID NO: 4091 - RNA, 20 nt, Homo sapiens
ccgcucaaagcaggcucgca

SEQ ID NO: 4092 - RNA, 20 nt, Homo sapiens
cgcucaaagcaggcucgcag

SEQ ID NO: 4093 - RNA, 20 nt, Homo sapiens
gcucaaagcaggcucgcagg

SEQ ID NO: 4094 - RNA, 20 nt, Homo sapiens
cucaaagcaggcucgcaggg

SEQ ID NO: 4095 - RNA, 20 nt, Homo sapiens
ucaaagcaggcucgcagggc

SEQ ID NO: 4096 - RNA, 20 nt, Homo sapiens
caaagcaggcucgcagggcc

SEQ ID NO: 4097 - RNA, 20 nt, Homo sapiens
aaagcaggcucgcagggccu

SEQ ID NO: 4098 - RNA, 20 nt, Homo sapiens
aagcaggcucgcagggccuc

SEQ ID NO: 4099 - RNA, 20 nt, Homo sapiens
agcaggcucgcagggccucg

SEQ ID NO: 4100 - RNA, 20 nt, Homo sapiens
gcaggcucgcagggccucgc

SEQ ID NO: 4101 - RNA, 20 nt, Homo sapiens
caggcucgcagggccucgcu

SEQ ID NO: 4102 - RNA, 20 nt, Homo sapiens
aggcucgcagggccucgcuu

SEQ ID NO: 4103 - RNA, 20 nt, Homo sapiens
ggcucgcagggccucgcuuu

SEQ ID NO: 4104 - RNA, 20 nt, Homo sapiens
gcucgcagggccucgcuuug

SEQ ID NO: 4105 - RNA, 20 nt, Homo sapiens
cucgcagggccucgcuuugg

SEQ ID NO: 4106 - RNA, 20 nt, Homo sapiens
ucgcagggccucgcuuuggc

SEQ ID NO: 4107 - RNA, 20 nt, Homo sapiens
cgcagggccucgcuuuggcu

SEQ ID NO: 4108 - RNA, 20 nt, Homo sapiens
gcagggccucgcuuuggcuc

SEQ ID NO: 4109 - RNA, 20 nt, Homo sapiens
cagggccucgcuuuggcucg

SEQ ID NO: 4110 - RNA, 20 nt, Homo sapiens
agggccucgcuuuggcucgg

SEQ ID NO: 4111 - RNA, 20 nt, Homo sapiens
gggccucgcuuuggcucggg

SEQ ID NO: 4112 - RNA, 20 nt, Homo sapiens
ggccucgcuuuggcucgggg

SEQ ID NO: 4113 - RNA, 20 nt, Homo sapiens
gccucgcuuuggcucggggu

SEQ ID NO: 4114 - RNA, 20 nt, Homo sapiens
ccucgcuuuggcucgggguc

SEQ ID NO: 4115 - RNA, 20 nt, Homo sapiens
cucgcuuuggcucggggucc

SEQ ID NO: 4116 - RNA, 20 nt, Homo sapiens
ucgcuuuggcucggggucca

SEQ ID NO: 4117 - RNA, 20 nt, Homo sapiens
cgcuuuggcucgggguccaa

SEQ ID NO: 4118 - RNA, 20 nt, Homo sapiens
gcuuuggcucgggguccaaa

SEQ ID NO: 4119 - RNA, 20 nt, Homo sapiens
cuuuggcucgggguccaaac

SEQ ID NO: 4120 - RNA, 20 nt, Homo sapiens
uuuggcucgggguccaaacg

SEQ ID NO: 4121 - RNA, 20 nt, Homo sapiens
uuggcucgggguccaaacga

SEQ ID NO: 4122 - RNA, 20 nt, Homo sapiens
uggcucgggguccaaacgag

SEQ ID NO: 4123 - RNA, 20 nt, Homo sapiens
ggcucgggguccaaacgagu

SEQ ID NO: 4124 - RNA, 20 nt, Homo sapiens
gcucgggguccaaacgaguc

SEQ ID NO: 4125 - RNA, 20 nt, Homo sapiens
cucgggguccaaacgagucu

SEQ ID NO: 4126 - RNA, 20 nt, Homo sapiens
ucgggguccaaacgagucuc

SEQ ID NO: 4127 - RNA, 20 nt, Homo sapiens
cgggguccaaacgagucucc

SEQ ID NO: 4128 - RNA, 20 nt, Homo sapiens
gggguccaaacgagucuccg

SEQ ID NO: 4129 - RNA, 20 nt, Homo sapiens
ggguccaaacgagucuccgu

SEQ ID NO: 4130 - RNA, 20 nt, Homo sapiens
gguccaaacgagucuccguc

SEQ ID NO: 4131 - RNA, 20 nt, Homo sapiens
guccaaacgagucuccgucg

SEQ ID NO: 4132 - RNA, 20 nt, Homo sapiens
uccaaacgagucuccgucgc

SEQ ID NO: 4133 - RNA, 20 nt, Homo sapiens
ccaaacgagucuccgucgcc

SEQ ID NO: 4134 - RNA, 20 nt, Homo sapiens
caaacgagucuccgucgccg

SEQ ID NO: 4135 - RNA, 20 nt, Homo sapiens
aaacgagucuccgucgccgu

SEQ ID NO: 4136 - RNA, 20 nt, Homo sapiens
aacgagucuccgucgccguc

SEQ ID NO: 4137 - RNA, 20 nt, Homo sapiens
acgagucuccgucgccgucc

SEQ ID NO: 4138 - RNA, 20 nt, Homo sapiens
cgagucuccgucgccguccu

SEQ ID NO: 4139 - RNA, 20 nt, Homo sapiens
gagucuccgucgccguccuc

SEQ ID NO: 4140 - RNA, 20 nt, Homo sapiens
agucuccgucgccguccucg

SEQ ID NO: 4141 - RNA, 20 nt, Homo sapiens
gucuccgucgccguccucgu

SEQ ID NO: 4142 - RNA, 20 nt, Homo sapiens
ucuccgucgccguccucguc

SEQ ID NO: 4143 - RNA, 20 nt, Homo sapiens
cuccgucgccguccucgucc

SEQ ID NO: 4144 - RNA, 20 nt, Homo sapiens
uccgucgccguccucguccc

SEQ ID NO: 4145 - RNA, 20 nt, Homo sapiens
ccgucgccguccucgucccc

SEQ ID NO: 4146 - RNA, 20 nt, Homo sapiens
cgucgccguccucguccccg

SEQ ID NO: 4147 - RNA, 20 nt, Homo sapiens
gucgccguccucguccccgg

SEQ ID NO: 4148 - RNA, 20 nt, Homo sapiens
ucgccguccucguccccggg

SEQ ID NO: 4149 - RNA, 20 nt, Homo sapiens
cgccguccucguccccgggc

SEQ ID NO: 4150 - RNA, 20 nt, Homo sapiens
gccguccucguccccgggcu

SEQ ID NO: 4151 - RNA, 20 nt, Homo sapiens
ccguccucguccccgggcuu

SEQ ID NO: 4152 - RNA, 20 nt, Homo sapiens
cguccucguccccgggcuuc

SEQ ID NO: 4153 - RNA, 20 nt, Homo sapiens
guccucguccccgggcuucc

SEQ ID NO: 4154 - RNA, 20 nt, Homo sapiens
uccucguccccgggcuuccg

SEQ ID NO: 4155 - RNA, 20 nt, Homo sapiens
ccucguccccgggcuuccgc

SEQ ID NO: 4156 - RNA, 20 nt, Homo sapiens
cucguccccgggcuuccgcg

SEQ ID NO: 4157 - RNA, 20 nt, Homo sapiens
ucguccccgggcuuccgcgg

SEQ ID NO: 4158 - RNA, 20 nt, Homo sapiens
cguccccgggcuuccgcggg

SEQ ID NO: 4159 - RNA, 20 nt, Homo sapiens
guccccgggcuuccgcgggg

SEQ ID NO: 4160 - RNA, 20 nt, Homo sapiens
uccccgggcuuccgcgggga

SEQ ID NO: 4161 - RNA, 20 nt, Homo sapiens
ccccgggcuuccgcggggag

SEQ ID NO: 4162 - RNA, 20 nt, Homo sapiens
cccgggcuuccgcggggagg

SEQ ID NO: 4163 - RNA, 20 nt, Homo sapiens
ccgggcuuccgcggggaggg

SEQ ID NO: 4164 - RNA, 20 nt, Homo sapiens
cgggcuuccgcggggagggu

SEQ ID NO: 4165 - RNA, 20 nt, Homo sapiens
gggcuuccgcggggagggug

SEQ ID NO: 4166 - RNA, 20 nt, Homo sapiens
ggcuuccgcggggagggugc

SEQ ID NO: 4167 - RNA, 20 nt, Homo sapiens
gcuuccgcggggagggugcu

SEQ ID NO: 4168 - RNA, 20 nt, Homo sapiens
cuuccgcggggagggugcug

SEQ ID NO: 4169 - RNA, 20 nt, Homo sapiens
uuccgcggggagggugcugu

SEQ ID NO: 4170 - RNA, 20 nt, Homo sapiens
uccgcggggagggugcuguc

SEQ ID NO: 4171 - RNA, 20 nt, Homo sapiens
ccgcggggagggugcugucc

SEQ ID NO: 4172 - RNA, 20 nt, Homo sapiens
cgcggggagggugcuguccg

SEQ ID NO: 4173 - RNA, 20 nt, Homo sapiens
gcggggagggugcuguccga

SEQ ID NO: 4174 - RNA, 20 nt, Homo sapiens
cggggagggugcuguccgag

SEQ ID NO: 4175 - RNA, 20 nt, Homo sapiens
ggggagggugcuguccgagg

SEQ ID NO: 4176 - RNA, 20 nt, Homo sapiens
gggagggugcuguccgaggg

SEQ ID NO: 4177 - RNA, 20 nt, Homo sapiens
ggagggugcuguccgagggu

SEQ ID NO: 4178 - RNA, 20 nt, Homo sapiens
gagggugcuguccgagggug

SEQ ID NO: 4179 - RNA, 20 nt, Homo sapiens
agggugcuguccgagggugu

SEQ ID NO: 4180 - RNA, 20 nt, Homo sapiens
gggugcuguccgaggguguc

SEQ ID NO: 4181 - RNA, 20 nt, Homo sapiens
ggugcuguccgagggugucg

SEQ ID NO: 4182 - RNA, 20 nt, Homo sapiens
gugcuguccgagggugucgg

SEQ ID NO: 4183 - RNA, 20 nt, Homo sapiens
ugcuguccgagggugucggg

SEQ ID NO: 4184 - RNA, 20 nt, Homo sapiens
gcuguccgagggugucggga

SEQ ID NO: 4185 - RNA, 20 nt, Homo sapiens
cuguccgagggugucgggag

SEQ ID NO: 4186 - RNA, 20 nt, Homo sapiens
uguccgagggugucgggagg

SEQ ID NO: 4187 - RNA, 20 nt, Homo sapiens
guccgagggugucgggaggg

SEQ ID NO: 4188 - RNA, 20 nt, Homo sapiens
uccgagggugucgggagggc

SEQ ID NO: 4189 - RNA, 20 nt, Homo sapiens
ccgagggugucgggagggcc

SEQ ID NO: 4190 - RNA, 20 nt, Homo sapiens
cgagggugucgggagggcca

SEQ ID NO: 4191 - RNA, 20 nt, Homo sapiens
gagggugucgggagggccau

SEQ ID NO: 4192 - RNA, 20 nt, Homo sapiens
agggugucgggagggccauc

SEQ ID NO: 4193 - RNA, 20 nt, Homo sapiens
gggugucgggagggccaucg

SEQ ID NO: 4194 - RNA, 20 nt, Homo sapiens
ggugucgggagggccaucgc

SEQ ID NO: 4195 - RNA, 20 nt, Homo sapiens
gugucgggagggccaucgcg

SEQ ID NO: 4196 - RNA, 20 nt, Homo sapiens
ugucgggagggccaucgcgg

SEQ ID NO: 4197 - RNA, 20 nt, Homo sapiens
gucgggagggccaucgcggu

SEQ ID NO: 4198 - RNA, 20 nt, Homo sapiens
ucgggagggccaucgcggug

SEQ ID NO: 4199 - RNA, 20 nt, Homo sapiens
cgggagggccaucgcgguga

SEQ ID NO: 4200 - RNA, 20 nt, Homo sapiens
gggagggccaucgcggugag

SEQ ID NO: 4201 - RNA, 20 nt, Homo sapiens
ggagggccaucgcggugagc

SEQ ID NO: 4202 - RNA, 20 nt, Homo sapiens
gagggccaucgcggugagcc

SEQ ID NO: 4203 - RNA, 20 nt, Homo sapiens
agggccaucgcggugagccc

SEQ ID NO: 4204 - RNA, 20 nt, Homo sapiens
gggccaucgcggugagcccc

SEQ ID NO: 4205 - RNA, 20 nt, Homo sapiens
ggccaucgcggugagccccg

SEQ ID NO: 4206 - RNA, 20 nt, Homo sapiens
gccaucgcggugagccccgg

SEQ ID NO: 4207 - RNA, 20 nt, Homo sapiens
ccaucgcggugagccccggc

SEQ ID NO: 4208 - RNA, 20 nt, Homo sapiens
caucgcggugagccccggcc

SEQ ID NO: 4209 - RNA, 20 nt, Homo sapiens
aucgcggugagccccggccg

SEQ ID NO: 4210 - RNA, 20 nt, Homo sapiens
ucgcggugagccccggccgg

SEQ ID NO: 4211 - RNA, 20 nt, Homo sapiens
cgcggugagccccggccgga

SEQ ID NO: 4212 - RNA, 20 nt, Homo sapiens
gcggugagccccggccggaa

SEQ ID NO: 4213 - RNA, 20 nt, Homo sapiens
cggugagccccggccggaau

SEQ ID NO: 4214 - RNA, 20 nt, Homo sapiens
ggugagccccggccggaauu

SEQ ID NO: 4215 - RNA, 20 nt, Homo sapiens
gugagccccggccggaauuu

SEQ ID NO: 4216 - RNA, 20 nt, Homo sapiens
ugagccccggccggaauuuc

SEQ ID NO: 4217 - RNA, 20 nt, Homo sapiens
gagccccggccggaauuuca

SEQ ID NO: 4218 - RNA, 20 nt, Homo sapiens
agccccggccggaauuucac

SEQ ID NO: 4219 - RNA, 20 nt, Homo sapiens
gccccggccggaauuucacg

SEQ ID NO: 4220 - RNA, 20 nt, Homo sapiens
ccccggccggaauuucacgg

SEQ ID NO: 4221 - RNA, 20 nt, Homo sapiens
cccggccggaauuucacgga

SEQ ID NO: 4222 - RNA, 20 nt, Homo sapiens
ccggccggaauuucacggac

SEQ ID NO: 4223 - RNA, 20 nt, Homo sapiens
cggccggaauuucacggacg

SEQ ID NO: 4224 - RNA, 20 nt, Homo sapiens
ggccggaauuucacggacgg

SEQ ID NO: 4225 - RNA, 20 nt, Homo sapiens
gccggaauuucacggacgga

SEQ ID NO: 4226 - RNA, 20 nt, Homo sapiens
ccggaauuucacggacggac

SEQ ID NO: 4227 - RNA, 20 nt, Homo sapiens
cggaauuucacggacggacg

SEQ ID NO: 4228 - RNA, 20 nt, Homo sapiens
ggaauuucacggacggacgc

SEQ ID NO: 4229 - RNA, 20 nt, Homo sapiens
gaauuucacggacggacgcg

SEQ ID NO: 4230 - RNA, 20 nt, Homo sapiens
aauuucacggacggacgcgg

SEQ ID NO: 4231 - RNA, 20 nt, Homo sapiens
auuucacggacggacgcggg

SEQ ID NO: 4232 - RNA, 20 nt, Homo sapiens
uuucacggacggacgcgggc

SEQ ID NO: 4233 - RNA, 20 nt, Homo sapiens
uucacggacggacgcgggca

SEQ ID NO: 4234 - RNA, 20 nt, Homo sapiens
ucacggacggacgcgggcag

SEQ ID NO: 4235 - RNA, 20 nt, Homo sapiens
cacggacggacgcgggcaga

SEQ ID NO: 4236 - RNA, 20 nt, Homo sapiens
acggacggacgcgggcagag

SEQ ID NO: 4237 - RNA, 20 nt, Homo sapiens
cggacggacgcgggcagaga

SEQ ID NO: 4238 - RNA, 20 nt, Homo sapiens
ggacggacgcgggcagagag

SEQ ID NO: 4239 - RNA, 20 nt, Homo sapiens
gacggacgcgggcagagaga

SEQ ID NO: 4240 - RNA, 20 nt, Homo sapiens
acggacgcgggcagagagag

SEQ ID NO: 4241 - RNA, 20 nt, Homo sapiens
cggacgcgggcagagagagg

SEQ ID NO: 4242 - RNA, 20 nt, Homo sapiens
ggacgcgggcagagagaggc

SEQ ID NO: 4243 - RNA, 20 nt, Homo sapiens
gacgcgggcagagagaggcc

SEQ ID NO: 4244 - RNA, 20 nt, Homo sapiens
acgcgggcagagagaggccg

SEQ ID NO: 4245 - RNA, 20 nt, Homo sapiens
cgcgggcagagagaggccgg

SEQ ID NO: 4246 - RNA, 20 nt, Homo sapiens
gcgggcagagagaggccggc

SEQ ID NO: 4247 - RNA, 20 nt, Homo sapiens
cgggcagagagaggccggcg

SEQ ID NO: 4248 - RNA, 20 nt, Homo sapiens
gggcagagagaggccggcgg

SEQ ID NO: 4249 - RNA, 20 nt, Homo sapiens
ggcagagagaggccggcggg

SEQ ID NO: 4250 - RNA, 20 nt, Homo sapiens
gcagagagaggccggcgggc

SEQ ID NO: 4251 - RNA, 20 nt, Homo sapiens
cagagagaggccggcgggcu

SEQ ID NO: 4252 - RNA, 20 nt, Homo sapiens
agagagaggccggcgggcuc

SEQ ID NO: 4253 - RNA, 20 nt, Homo sapiens
gagagaggccggcgggcucc

SEQ ID NO: 4254 - RNA, 20 nt, Homo sapiens
agagaggccggcgggcuccc

SEQ ID NO: 4255 - RNA, 20 nt, Homo sapiens
gagaggccggcgggcucccg

SEQ ID NO: 4256 - RNA, 20 nt, Homo sapiens
agaggccggcgggcucccgu

SEQ ID NO: 4257 - RNA, 20 nt, Homo sapiens
gaggccggcgggcucccgug

SEQ ID NO: 4258 - RNA, 20 nt, Homo sapiens
aggccggcgggcucccgugc

SEQ ID NO: 4259 - RNA, 20 nt, Homo sapiens
ggccggcgggcucccgugca

SEQ ID NO: 4260 - RNA, 20 nt, Homo sapiens
gccggcgggcucccgugcac

SEQ ID NO: 4261 - RNA, 20 nt, Homo sapiens
ccggcgggcucccgugcacc

SEQ ID NO: 4262 - RNA, 20 nt, Homo sapiens
cggcgggcucccgugcaccu

SEQ ID NO: 4263 - RNA, 20 nt, Homo sapiens
ggcgggcucccgugcaccuc

SEQ ID NO: 4264 - RNA, 20 nt, Homo sapiens
gcgggcucccgugcaccuca

SEQ ID NO: 4265 - RNA, 20 nt, Homo sapiens
cgggcucccgugcaccucag

SEQ ID NO: 4266 - RNA, 20 nt, Homo sapiens
gggcucccgugcaccucagc

SEQ ID NO: 4267 - RNA, 20 nt, Homo sapiens
ggcucccgugcaccucagcc

SEQ ID NO: 4268 - RNA, 20 nt, Homo sapiens
gcucccgugcaccucagccg

SEQ ID NO: 4269 - RNA, 20 nt, Homo sapiens
cucccgugcaccucagccgg

SEQ ID NO: 4270 - RNA, 20 nt, Homo sapiens
ucccgugcaccucagccgga

SEQ ID NO: 4271 - RNA, 20 nt, Homo sapiens
cccgugcaccucagccggac

SEQ ID NO: 4272 - RNA, 20 nt, Homo sapiens
ccgugcaccucagccggacu

SEQ ID NO: 4273 - RNA, 20 nt, Homo sapiens
cgugcaccucagccggacug

SEQ ID NO: 4274 - RNA, 20 nt, Homo sapiens
gugcaccucagccggacugu

SEQ ID NO: 4275 - RNA, 20 nt, Homo sapiens
ugcaccucagccggacugug

SEQ ID NO: 4276 - RNA, 20 nt, Homo sapiens
gcaccucagccggacugugc

SEQ ID NO: 4277 - RNA, 20 nt, Homo sapiens
caccucagccggacugugca

SEQ ID NO: 4278 - RNA, 20 nt, Homo sapiens
accucagccggacugugcac

SEQ ID NO: 4279 - RNA, 20 nt, Homo sapiens
ccucagccggacugugcacu

SEQ ID NO: 4280 - RNA, 20 nt, Homo sapiens
cucagccggacugugcacug

SEQ ID NO: 4281 - RNA, 20 nt, Homo sapiens
ucagccggacugugcacugc

SEQ ID NO: 4282 - RNA, 20 nt, Homo sapiens
cagccggacugugcacugcg

SEQ ID NO: 4283 - RNA, 20 nt, Homo sapiens
agccggacugugcacugcgg

SEQ ID NO: 4284 - RNA, 20 nt, Homo sapiens
gccggacugugcacugcggc

SEQ ID NO: 4285 - RNA, 20 nt, Homo sapiens
ccggacugugcacugcggca

SEQ ID NO: 4286 - RNA, 20 nt, Homo sapiens
cggacugugcacugcggcag

SEQ ID NO: 4287 - RNA, 20 nt, Homo sapiens
ggacugugcacugcggcagg

SEQ ID NO: 4288 - RNA, 20 nt, Homo sapiens
gacugugcacugcggcaggu

SEQ ID NO: 4289 - RNA, 20 nt, Homo sapiens
acugugcacugcggcaggug

SEQ ID NO: 4290 - RNA, 20 nt, Homo sapiens
cugugcacugcggcaggugc

SEQ ID NO: 4291 - RNA, 20 nt, Homo sapiens
ugugcacugcggcaggugca

SEQ ID NO: 4292 - RNA, 20 nt, Homo sapiens
gugcacugcggcaggugcag

SEQ ID NO: 4293 - RNA, 20 nt, Homo sapiens
ugcacugcggcaggugcagc

SEQ ID NO: 4294 - RNA, 20 nt, Homo sapiens
gcacugcggcaggugcagcc

SEQ ID NO: 4295 - RNA, 20 nt, Homo sapiens
cacugcggcaggugcagcca

SEQ ID NO: 4296 - RNA, 20 nt, Homo sapiens
acugcggcaggugcagccag

SEQ ID NO: 4297 - RNA, 20 nt, Homo sapiens
cugcggcaggugcagccagg

SEQ ID NO: 4298 - RNA, 20 nt, Homo sapiens
ugcggcaggugcagccagga

SEQ ID NO: 4299 - RNA, 20 nt, Homo sapiens
gcggcaggugcagccaggag

SEQ ID NO: 4300 - RNA, 20 nt, Homo sapiens
cggcaggugcagccaggagg

SEQ ID NO: 4301 - RNA, 20 nt, Homo sapiens
ggcaggugcagccaggaggc

SEQ ID NO: 4302 - RNA, 20 nt, Homo sapiens
gcaggugcagccaggaggcc

SEQ ID NO: 4303 - RNA, 20 nt, Homo sapiens
caggugcagccaggaggccu

SEQ ID NO: 4304 - RNA, 20 nt, Homo sapiens
aggugcagccaggaggccug

SEQ ID NO: 4305 - RNA, 20 nt, Homo sapiens
ggugcagccaggaggccugc

SEQ ID NO: 4306 - RNA, 20 nt, Homo sapiens
gugcagccaggaggccugcc

SEQ ID NO: 4307 - RNA, 20 nt, Homo sapiens
ugcagccaggaggccugccc

SEQ ID NO: 4308 - RNA, 20 nt, Homo sapiens
gcagccaggaggccugcccg

SEQ ID NO: 4309 - RNA, 20 nt, Homo sapiens
cagccaggaggccugcccgg

SEQ ID NO: 4310 - RNA, 20 nt, Homo sapiens
agccaggaggccugcccgga

SEQ ID NO: 4311 - RNA, 20 nt, Homo sapiens
gccaggaggccugcccggac

SEQ ID NO: 4312 - RNA, 20 nt, Homo sapiens
ccaggaggccugcccggaca

SEQ ID NO: 4313 - RNA, 20 nt, Homo sapiens
caggaggccugcccggacag

SEQ ID NO: 4314 - RNA, 20 nt, Homo sapiens
aggaggccugcccggacagc

SEQ ID NO: 4315 - RNA, 20 nt, Homo sapiens
ggaggccugcccggacagcc

SEQ ID NO: 4316 - RNA, 20 nt, Homo sapiens
gaggccugcccggacagcca

SEQ ID NO: 4317 - RNA, 20 nt, Homo sapiens
aggccugcccggacagccag

SEQ ID NO: 4318 - RNA, 20 nt, Homo sapiens
ggccugcccggacagccagc

SEQ ID NO: 4319 - RNA, 20 nt, Homo sapiens
gccugcccggacagccagcc

SEQ ID NO: 4320 - RNA, 20 nt, Homo sapiens
ccugcccggacagccagcca

SEQ ID NO: 4321 - RNA, 20 nt, Homo sapiens
cugcccggacagccagccag

SEQ ID NO: 4322 - RNA, 20 nt, Homo sapiens
ugcccggacagccagccagc

SEQ ID NO: 4323 - RNA, 20 nt, Homo sapiens
gcccggacagccagccagcc

SEQ ID NO: 4324 - RNA, 20 nt, Homo sapiens
cccggacagccagccagcca

SEQ ID NO: 4325 - RNA, 20 nt, Homo sapiens
ccggacagccagccagccag

SEQ ID NO: 4326 - RNA, 20 nt, Homo sapiens
cggacagccagccagccagc

SEQ ID NO: 4327 - RNA, 20 nt, Homo sapiens
ggacagccagccagccagcc

SEQ ID NO: 4328 - RNA, 20 nt, Homo sapiens
gacagccagccagccagcca

SEQ ID NO: 4329 - RNA, 20 nt, Homo sapiens
acagccagccagccagccag

SEQ ID NO: 4330 - RNA, 20 nt, Homo sapiens
cagccagccagccagccagc

SEQ ID NO: 4331 - RNA, 20 nt, Homo sapiens
agccagccagccagccagcc

SEQ ID NO: 4332 - RNA, 20 nt, Homo sapiens
gccagccagccagccagccg

SEQ ID NO: 4333 - RNA, 20 nt, Homo sapiens
ccagccagccagccagccgc

SEQ ID NO: 4334 - RNA, 20 nt, Homo sapiens
cagccagccagccagccgcc

SEQ ID NO: 4335 - RNA, 20 nt, Homo sapiens
agccagccagccagccgccc

SEQ ID NO: 4336 - RNA, 20 nt, Homo sapiens
gccagccagccagccgcccu

SEQ ID NO: 4337 - RNA, 20 nt, Homo sapiens
ccagccagccagccgcccuu

SEQ ID NO: 4338 - RNA, 20 nt, Homo sapiens
cagccagccagccgcccuug

SEQ ID NO: 4339 - RNA, 20 nt, Homo sapiens
agccagccagccgcccuugu

SEQ ID NO: 4340 - RNA, 20 nt, Homo sapiens
gccagccagccgcccuugua

SEQ ID NO: 4341 - RNA, 20 nt, Homo sapiens
ccagccagccgcccuuguaa

SEQ ID NO: 4342 - RNA, 20 nt, Homo sapiens
cagccagccgcccuuguaaa

SEQ ID NO: 4343 - RNA, 20 nt, Homo sapiens
agccagccgcccuuguaaag

SEQ ID NO: 4344 - RNA, 20 nt, Homo sapiens
gccagccgcccuuguaaagg

SEQ ID NO: 4345 - RNA, 20 nt, Homo sapiens
ccagccgcccuuguaaaggc

SEQ ID NO: 4346 - RNA, 20 nt, Homo sapiens
cagccgcccuuguaaaggcc

SEQ ID NO: 4347 - RNA, 20 nt, Homo sapiens
agccgcccuuguaaaggccc

SEQ ID NO: 4348 - RNA, 20 nt, Homo sapiens
gccgcccuuguaaaggccca

SEQ ID NO: 4349 - RNA, 20 nt, Homo sapiens
ccgcccuuguaaaggcccac

SEQ ID NO: 4350 - RNA, 20 nt, Homo sapiens
cgcccuuguaaaggcccaca

SEQ ID NO: 4351 - RNA, 20 nt, Homo sapiens
gcccuuguaaaggcccacag

SEQ ID NO: 4352 - RNA, 20 nt, Homo sapiens
cccuuguaaaggcccacagg

SEQ ID NO: 4353 - RNA, 20 nt, Homo sapiens
ccuuguaaaggcccacaggc

SEQ ID NO: 4354 - RNA, 20 nt, Homo sapiens
cuuguaaaggcccacaggca

SEQ ID NO: 4355 - RNA, 20 nt, Homo sapiens
uuguaaaggcccacaggcag

SEQ ID NO: 4356 - RNA, 20 nt, Homo sapiens
uguaaaggcccacaggcagg

SEQ ID NO: 4357 - RNA, 20 nt, Homo sapiens
guaaaggcccacaggcaggc

SEQ ID NO: 4358 - RNA, 20 nt, Homo sapiens
uaaaggcccacaggcaggca

SEQ ID NO: 4359 - RNA, 20 nt, Homo sapiens
aaaggcccacaggcaggcag

SEQ ID NO: 4360 - RNA, 20 nt, Homo sapiens
aaggcccacaggcaggcagg

SEQ ID NO: 4361 - RNA, 20 nt, Homo sapiens
aggcccacaggcaggcaggc

SEQ ID NO: 4362 - RNA, 20 nt, Homo sapiens
ggcccacaggcaggcaggcu

SEQ ID NO: 4363 - RNA, 20 nt, Homo sapiens
gcccacaggcaggcaggcuc

SEQ ID NO: 4364 - RNA, 20 nt, Homo sapiens
cccacaggcaggcaggcucc

SEQ ID NO: 4365 - RNA, 20 nt, Homo sapiens
ccacaggcaggcaggcucca

SEQ ID NO: 4366 - RNA, 20 nt, Homo sapiens
cacaggcaggcaggcuccac

SEQ ID NO: 4367 - RNA, 20 nt, Homo sapiens
acaggcaggcaggcuccacc

SEQ ID NO: 4368 - RNA, 20 nt, Homo sapiens
caggcaggcaggcuccaccc

SEQ ID NO: 4369 - RNA, 20 nt, Homo sapiens
aggcaggcaggcuccacccc

SEQ ID NO: 4370 - RNA, 20 nt, Homo sapiens
ggcaggcaggcuccaccccu

SEQ ID NO: 4371 - RNA, 20 nt, Homo sapiens
gcaggcaggcuccaccccuu

SEQ ID NO: 4372 - RNA, 20 nt, Homo sapiens
caggcaggcuccaccccuuc

SEQ ID NO: 4373 - RNA, 20 nt, Homo sapiens
aggcaggcuccaccccuuca

SEQ ID NO: 4374 - RNA, 41 nt, Homo sapiens
ggcaggcuccaccccuucaugagauguaacucuaauccagg

SEQ ID NO: 4375 - RNA, 21 nt, Homo sapiens
agauguaacucuaauccaggu

SEQ ID NO: 4376 - RNA, 21 nt, Homo sapiens
gauguaacucuaauccagguu

SEQ ID NO: 4377 - RNA, 21 nt, Homo sapiens
auguaacucuaauccagguuu

SEQ ID NO: 4378 - RNA, 21 nt, Homo sapiens
uguaacucuaauccagguuug

SEQ ID NO: 4379 - RNA, 21 nt, Homo sapiens
guaacucuaauccagguuugc

SEQ ID NO: 4380 - RNA, 21 nt, Homo sapiens
uaacucuaauccagguuugcc

SEQ ID NO: 4381 - RNA, 21 nt, Homo sapiens
aacucuaauccagguuugccu

SEQ ID NO: 4382 - RNA, 21 nt, Homo sapiens
acucuaauccagguuugccua

SEQ ID NO: 4383 - RNA, 21 nt, Homo sapiens
cucuaauccagguuugccuag

SEQ ID NO: 4384 - RNA, 21 nt, Homo sapiens
ucuaauccagguuugccuaga

SEQ ID NO: 4385 - RNA, 21 nt, Homo sapiens
cuaauccagguuugccuagac

SEQ ID NO: 4386 - RNA, 21 nt, Homo sapiens
uaauccagguuugccuagaca

SEQ ID NO: 4387 - RNA, 21 nt, Homo sapiens
aauccagguuugccuagacag

SEQ ID NO: 4388 - RNA, 21 nt, Homo sapiens
auccagguuugccuagacagc

SEQ ID NO: 4389 - RNA, 21 nt, Homo sapiens
uccagguuugccuagacagcg

SEQ ID NO: 4390 - RNA, 21 nt, Homo sapiens
ccagguuugccuagacagcgu

SEQ ID NO: 4391 - RNA, 21 nt, Homo sapiens
cagguuugccuagacagcguc

SEQ ID NO: 4392 - RNA, 21 nt, Homo sapiens
agguuugccuagacagcgucg

SEQ ID NO: 4393 - RNA, 21 nt, Homo sapiens
gguuugccuagacagcgucgg

SEQ ID NO: 4394 - RNA, 21 nt, Homo sapiens
guuugccuagacagcgucgga

SEQ ID NO: 4395 - RNA, 21 nt, Homo sapiens
uuugccuagacagcgucggaa

SEQ ID NO: 4396 - RNA, 21 nt, Homo sapiens
uugccuagacagcgucggaag

SEQ ID NO: 4397 - RNA, 21 nt, Homo sapiens
ugccuagacagcgucggaagg

SEQ ID NO: 4398 - RNA, 21 nt, Homo sapiens
gccuagacagcgucggaaggu

SEQ ID NO: 4399 - RNA, 21 nt, Homo sapiens
ccuagacagcgucggaaggug

SEQ ID NO: 4400 - RNA, 21 nt, Homo sapiens
cuagacagcgucggaaggugg

SEQ ID NO: 4401 - RNA, 21 nt, Homo sapiens
uagacagcgucggaagguggg

SEQ ID NO: 4402 - RNA, 21 nt, Homo sapiens
agacagcgucggaaggugggg

SEQ ID NO: 4403 - RNA, 21 nt, Homo sapiens
gacagcgucggaagguggggg

SEQ ID NO: 4404 - RNA, 21 nt, Homo sapiens
acagcgucggaaggugggggg

SEQ ID NO: 4405 - RNA, 21 nt, Homo sapiens
cagcgucggaaggugggggga

SEQ ID NO: 4406 - RNA, 21 nt, Homo sapiens
agcgucggaagguggggggag

SEQ ID NO: 4407 - RNA, 21 nt, Homo sapiens
gcgucggaagguggggggaga

SEQ ID NO: 4408 - RNA, 21 nt, Homo sapiens
cgucggaagguggggggagac

SEQ ID NO: 4409 - RNA, 21 nt, Homo sapiens
gucggaagguggggggagaca

SEQ ID NO: 4410 - RNA, 21 nt, Homo sapiens
ucggaagguggggggagacau

SEQ ID NO: 4411 - RNA, 21 nt, Homo sapiens
cggaagguggggggagacauu

SEQ ID NO: 4412 - RNA, 21 nt, Homo sapiens
ggaagguggggggagacauuc

SEQ ID NO: 4413 - RNA, 21 nt, Homo sapiens
gaagguggggggagacauuca

SEQ ID NO: 4414 - RNA, 21 nt, Homo sapiens
aagguggggggagacauucag

SEQ ID NO: 4415 - RNA, 21 nt, Homo sapiens
agguggggggagacauucagc

SEQ ID NO: 4416 - RNA, 21 nt, Homo sapiens
gguggggggagacauucagcc

SEQ ID NO: 4417 - RNA, 21 nt, Homo sapiens
guggggggagacauucagcca

SEQ ID NO: 4418 - RNA, 21 nt, Homo sapiens
uggggggagacauucagccag

SEQ ID NO: 4419 - RNA, 21 nt, Homo sapiens
ggggggagacauucagccaga

SEQ ID NO: 4420 - RNA, 21 nt, Homo sapiens
gggggagacauucagccagaa

SEQ ID NO: 4421 - RNA, 21 nt, Homo sapiens
ggggagacauucagccagaau

SEQ ID NO: 4422 - RNA, 21 nt, Homo sapiens
gggagacauucagccagaauu

SEQ ID NO: 4423 - RNA, 21 nt, Homo sapiens
ggagacauucagccagaauuu

SEQ ID NO: 4424 - RNA, 21 nt, Homo sapiens
gagacauucagccagaauuuc

SEQ ID NO: 4425 - RNA, 21 nt, Homo sapiens
agacauucagccagaauuuca

SEQ ID NO: 4426 - RNA, 21 nt, Homo sapiens
gacauucagccagaauuucac

SEQ ID NO: 4427 - RNA, 21 nt, Homo sapiens
acauucagccagaauuucacg

SEQ ID NO: 4428 - RNA, 21 nt, Homo sapiens
cauucagccagaauuucacgg

SEQ ID NO: 4429 - RNA, 21 nt, Homo sapiens
auucagccagaauuucacgga

SEQ ID NO: 4430 - RNA, 21 nt, Homo sapiens
uucagccagaauuucacggaa

SEQ ID NO: 4431 - RNA, 21 nt, Homo sapiens
ucagccagaauuucacggaag

SEQ ID NO: 4432 - RNA, 21 nt, Homo sapiens
cagccagaauuucacggaaga

SEQ ID NO: 4433 - RNA, 21 nt, Homo sapiens
agccagaauuucacggaagaa

SEQ ID NO: 4434 - RNA, 21 nt, Homo sapiens
gccagaauuucacggaagaac

SEQ ID NO: 4435 - RNA, 21 nt, Homo sapiens
ccagaauuucacggaagaaca

SEQ ID NO: 4436 - RNA, 21 nt, Homo sapiens
cagaauuucacggaagaacaa

SEQ ID NO: 4437 - RNA, 21 nt, Homo sapiens
agaauuucacggaagaacaag

SEQ ID NO: 4438 - RNA, 21 nt, Homo sapiens
gaauuucacggaagaacaagg

SEQ ID NO: 4439 - RNA, 21 nt, Homo sapiens
aauuucacggaagaacaaggg

SEQ ID NO: 4440 - RNA, 21 nt, Homo sapiens
auuucacggaagaacaagggc

SEQ ID NO: 4441 - RNA, 21 nt, Homo sapiens
uuucacggaagaacaagggca

SEQ ID NO: 4442 - RNA, 21 nt, Homo sapiens
uucacggaagaacaagggcac

SEQ ID NO: 4443 - RNA, 21 nt, Homo sapiens
ucacggaagaacaagggcaca

SEQ ID NO: 4444 - RNA, 21 nt, Homo sapiens
cacggaagaacaagggcacag

SEQ ID NO: 4445 - RNA, 21 nt, Homo sapiens
acggaagaacaagggcacaga

SEQ ID NO: 4446 - RNA, 21 nt, Homo sapiens
cggaagaacaagggcacagag

SEQ ID NO: 4447 - RNA, 21 nt, Homo sapiens
ggaagaacaagggcacagaga

SEQ ID NO: 4448 - RNA, 21 nt, Homo sapiens
gaagaacaagggcacagagag

SEQ ID NO: 4449 - RNA, 21 nt, Homo sapiens
aagaacaagggcacagagagg

SEQ ID NO: 4450 - RNA, 21 nt, Homo sapiens
agaacaagggcacagagaggc

SEQ ID NO: 4451 - RNA, 21 nt, Homo sapiens
gaacaagggcacagagaggcc

SEQ ID NO: 4452 - RNA, 21 nt, Homo sapiens
aacaagggcacagagaggcca

SEQ ID NO: 4453 - RNA, 21 nt, Homo sapiens
acaagggcacagagaggccag

SEQ ID NO: 4454 - RNA, 21 nt, Homo sapiens
caagggcacagagaggccagc

SEQ ID NO: 4455 - RNA, 21 nt, Homo sapiens
aagggcacagagaggccagcg

SEQ ID NO: 4456 - RNA, 21 nt, Homo sapiens
agggcacagagaggccagcga

SEQ ID NO: 4457 - RNA, 21 nt, Homo sapiens
gggcacagagaggccagcgag

SEQ ID NO: 4458 - RNA, 21 nt, Homo sapiens
ggcacagagaggccagcgagc

SEQ ID NO: 4459 - RNA, 21 nt, Homo sapiens
gcacagagaggccagcgagcu

SEQ ID NO: 4460 - RNA, 21 nt, Homo sapiens
cacagagaggccagcgagcuc

SEQ ID NO: 4461 - RNA, 21 nt, Homo sapiens
acagagaggccagcgagcucc

SEQ ID NO: 4462 - RNA, 21 nt, Homo sapiens
cagagaggccagcgagcuccc

SEQ ID NO: 4463 - RNA, 21 nt, Homo sapiens
agagaggccagcgagcucccu

SEQ ID NO: 4464 - RNA, 21 nt, Homo sapiens
gagaggccagcgagcucccuu

SEQ ID NO: 4465 - RNA, 21 nt, Homo sapiens
agaggccagcgagcucccuug

SEQ ID NO: 4466 - RNA, 21 nt, Homo sapiens
gaggccagcgagcucccuugc

SEQ ID NO: 4467 - RNA, 21 nt, Homo sapiens
aggccagcgagcucccuugca

SEQ ID NO: 4468 - RNA, 21 nt, Homo sapiens
ggccagcgagcucccuugcac

SEQ ID NO: 4469 - RNA, 21 nt, Homo sapiens
gccagcgagcucccuugcacg

SEQ ID NO: 4470 - RNA, 21 nt, Homo sapiens
ccagcgagcucccuugcacgu

SEQ ID NO: 4471 - RNA, 21 nt, Homo sapiens
cagcgagcucccuugcacguc

SEQ ID NO: 4472 - RNA, 21 nt, Homo sapiens
agcgagcucccuugcacguca

SEQ ID NO: 4473 - RNA, 21 nt, Homo sapiens
gcgagcucccuugcacgucag

SEQ ID NO: 4474 - RNA, 21 nt, Homo sapiens
cgagcucccuugcacgucagc

SEQ ID NO: 4475 - RNA, 21 nt, Homo sapiens
gagcucccuugcacgucagcc

SEQ ID NO: 4476 - RNA, 21 nt, Homo sapiens
agcucccuugcacgucagccg

SEQ ID NO: 4477 - RNA, 21 nt, Homo sapiens
gcucccuugcacgucagccgg

SEQ ID NO: 4478 - RNA, 21 nt, Homo sapiens
cucccuugcacgucagccggg

SEQ ID NO: 4479 - RNA, 21 nt, Homo sapiens
ucccuugcacgucagccgggg

SEQ ID NO: 4480 - RNA, 21 nt, Homo sapiens
cccuugcacgucagccggggu

SEQ ID NO: 4481 - RNA, 21 nt, Homo sapiens
ccuugcacgucagccggggug

SEQ ID NO: 4482 - RNA, 21 nt, Homo sapiens
cuugcacgucagccggggugc

SEQ ID NO: 4483 - RNA, 21 nt, Homo sapiens
uugcacgucagccggggugcg

SEQ ID NO: 4484 - RNA, 21 nt, Homo sapiens
ugcacgucagccggggugcgc

SEQ ID NO: 4485 - RNA, 21 nt, Homo sapiens
gcacgucagccggggugcgca

SEQ ID NO: 4486 - RNA, 21 nt, Homo sapiens
cacgucagccggggugcgcac

SEQ ID NO: 4487 - RNA, 21 nt, Homo sapiens
acgucagccggggugcgcacu

SEQ ID NO: 4488 - RNA, 21 nt, Homo sapiens
cgucagccggggugcgcacug

SEQ ID NO: 4489 - RNA, 21 nt, Homo sapiens
gucagccggggugcgcacugc

SEQ ID NO: 4490 - RNA, 21 nt, Homo sapiens
ucagccggggugcgcacugcg

SEQ ID NO: 4491 - RNA, 21 nt, Homo sapiens
cagccggggugcgcacugcgc

SEQ ID NO: 4492 - RNA, 21 nt, Homo sapiens
agccggggugcgcacugcgcg

SEQ ID NO: 4493 - RNA, 21 nt, Homo sapiens
gccggggugcgcacugcgcgc

SEQ ID NO: 4494 - RNA, 21 nt, Homo sapiens
ccggggugcgcacugcgcgca

SEQ ID NO: 4495 - RNA, 21 nt, Homo sapiens
cggggugcgcacugcgcgcag

SEQ ID NO: 4496 - RNA, 21 nt, Homo sapiens
ggggugcgcacugcgcgcagg

SEQ ID NO: 4497 - RNA, 21 nt, Homo sapiens
gggugcgcacugcgcgcaggu

SEQ ID NO: 4498 - RNA, 21 nt, Homo sapiens
ggugcgcacugcgcgcagguc

SEQ ID NO: 4499 - RNA, 21 nt, Homo sapiens
gugcgcacugcgcgcaggucu

SEQ ID NO: 4500 - RNA, 21 nt, Homo sapiens
ugcgcacugcgcgcaggucua

SEQ ID NO: 4501 - RNA, 21 nt, Homo sapiens
gcgcacugcgcgcaggucuag

SEQ ID NO: 4502 - RNA, 21 nt, Homo sapiens
cgcacugcgcgcaggucuagc

SEQ ID NO: 4503 - RNA, 21 nt, Homo sapiens
gcacugcgcgcaggucuagcc

SEQ ID NO: 4504 - RNA, 21 nt, Homo sapiens
cacugcgcgcaggucuagcca

SEQ ID NO: 4505 - RNA, 21 nt, Homo sapiens
acugcgcgcaggucuagccag

SEQ ID NO: 4506 - RNA, 21 nt, Homo sapiens
cugcgcgcaggucuagccagg

SEQ ID NO: 4507 - RNA, 21 nt, Homo sapiens
ugcgcgcaggucuagccagga

SEQ ID NO: 4508 - RNA, 21 nt, Homo sapiens
gcgcgcaggucuagccaggaa

SEQ ID NO: 4509 - RNA, 21 nt, Homo sapiens
cgcgcaggucuagccaggaag

SEQ ID NO: 4510 - RNA, 21 nt, Homo sapiens
gcgcaggucuagccaggaagc

SEQ ID NO: 4511 - RNA, 21 nt, Homo sapiens
cgcaggucuagccaggaagcg

SEQ ID NO: 4512 - RNA, 21 nt, Homo sapiens
gcaggucuagccaggaagcgg

SEQ ID NO: 4513 - RNA, 21 nt, Homo sapiens
caggucuagccaggaagcggg

SEQ ID NO: 4514 - RNA, 21 nt, Homo sapiens
aggucuagccaggaagcgggc

SEQ ID NO: 4515 - RNA, 21 nt, Homo sapiens
ggucuagccaggaagcgggca

SEQ ID NO: 4516 - RNA, 21 nt, Homo sapiens
gucuagccaggaagcgggcaa

SEQ ID NO: 4517 - RNA, 21 nt, Homo sapiens
ucuagccaggaagcgggcaaa

SEQ ID NO: 4518 - RNA, 21 nt, Homo sapiens
cuagccaggaagcgggcaaag

SEQ ID NO: 4519 - RNA, 21 nt, Homo sapiens
uagccaggaagcgggcaaaga

SEQ ID NO: 4520 - RNA, 21 nt, Homo sapiens
agccaggaagcgggcaaagac

SEQ ID NO: 4521 - RNA, 21 nt, Homo sapiens
gccaggaagcgggcaaagaca

SEQ ID NO: 4522 - RNA, 21 nt, Homo sapiens
ccaggaagcgggcaaagacag

SEQ ID NO: 4523 - RNA, 21 nt, Homo sapiens
caggaagcgggcaaagacaga

SEQ ID NO: 4524 - RNA, 21 nt, Homo sapiens
aggaagcgggcaaagacagac

SEQ ID NO: 4525 - RNA, 21 nt, Homo sapiens
ggaagcgggcaaagacagaca

SEQ ID NO: 4526 - RNA, 21 nt, Homo sapiens
gaagcgggcaaagacagacag

SEQ ID NO: 4527 - RNA, 21 nt, Homo sapiens
aagcgggcaaagacagacaga

SEQ ID NO: 4528 - RNA, 21 nt, Homo sapiens
agcgggcaaagacagacagag

SEQ ID NO: 4529 - RNA, 21 nt, Homo sapiens
gcgggcaaagacagacagagg

SEQ ID NO: 4530 - RNA, 21 nt, Homo sapiens
cgggcaaagacagacagaggu

SEQ ID NO: 4531 - RNA, 21 nt, Homo sapiens
gggcaaagacagacagaggua

SEQ ID NO: 4532 - RNA, 21 nt, Homo sapiens
ggcaaagacagacagagguau

SEQ ID NO: 4533 - RNA, 21 nt, Homo sapiens
gcaaagacagacagagguaug

SEQ ID NO: 4534 - RNA, 21 nt, Homo sapiens
caaagacagacagagguaugc

SEQ ID NO: 4535 - RNA, 21 nt, Homo sapiens
aaagacagacagagguaugcu

SEQ ID NO: 4536 - RNA, 21 nt, Homo sapiens
aagacagacagagguaugcuu

SEQ ID NO: 4537 - RNA, 21 nt, Homo sapiens
agacagacagagguaugcuuu

SEQ ID NO: 4538 - RNA, 21 nt, Homo sapiens
gacagacagagguaugcuuuu

SEQ ID NO: 4539 - RNA, 21 nt, Homo sapiens
acagacagagguaugcuuuug

SEQ ID NO: 4540 - RNA, 21 nt, Homo sapiens
cagacagagguaugcuuuuga

SEQ ID NO: 4541 - RNA, 21 nt, Homo sapiens
agacagagguaugcuuuugac

SEQ ID NO: 4542 - RNA, 21 nt, Homo sapiens
gacagagguaugcuuuugacc

SEQ ID NO: 4543 - RNA, 21 nt, Homo sapiens
acagagguaugcuuuugaccg

SEQ ID NO: 4544 - RNA, 21 nt, Homo sapiens
cagagguaugcuuuugaccgc

SEQ ID NO: 4545 - RNA, 21 nt, Homo sapiens
agagguaugcuuuugaccgcc

SEQ ID NO: 4546 - RNA, 21 nt, Homo sapiens
gagguaugcuuuugaccgcca

SEQ ID NO: 4547 - RNA, 21 nt, Homo sapiens
agguaugcuuuugaccgccag

SEQ ID NO: 4548 - RNA, 21 nt, Homo sapiens
gguaugcuuuugaccgccagg

SEQ ID NO: 4549 - RNA, 21 nt, Homo sapiens
guaugcuuuugaccgccagga

SEQ ID NO: 4550 - RNA, 21 nt, Homo sapiens
uaugcuuuugaccgccaggag

SEQ ID NO: 4551 - RNA, 21 nt, Homo sapiens
augcuuuugaccgccaggagc

SEQ ID NO: 4552 - RNA, 21 nt, Homo sapiens
ugcuuuugaccgccaggagcu

SEQ ID NO: 4553 - RNA, 21 nt, Homo sapiens
gcuuuugaccgccaggagcuc

SEQ ID NO: 4554 - RNA, 21 nt, Homo sapiens
cuuuugaccgccaggagcucc

SEQ ID NO: 4555 - RNA, 21 nt, Homo sapiens
uuuugaccgccaggagcuccg

SEQ ID NO: 4556 - RNA, 21 nt, Homo sapiens
uuugaccgccaggagcuccgc

SEQ ID NO: 4557 - RNA, 21 nt, Homo sapiens
uugaccgccaggagcuccgcg

SEQ ID NO: 4558 - RNA, 21 nt, Homo sapiens
ugaccgccaggagcuccgcgc

SEQ ID NO: 4559 - RNA, 21 nt, Homo sapiens
gaccgccaggagcuccgcgcu

SEQ ID NO: 4560 - RNA, 21 nt, Homo sapiens
accgccaggagcuccgcgcug

SEQ ID NO: 4561 - RNA, 21 nt, Homo sapiens
ccgccaggagcuccgcgcugg

SEQ ID NO: 4562 - RNA, 21 nt, Homo sapiens
cgccaggagcuccgcgcuggc

SEQ ID NO: 4563 - RNA, 21 nt, Homo sapiens
gccaggagcuccgcgcuggca

SEQ ID NO: 4564 - RNA, 21 nt, Homo sapiens
ccaggagcuccgcgcuggcag

SEQ ID NO: 4565 - RNA, 21 nt, Homo sapiens
caggagcuccgcgcuggcagc

SEQ ID NO: 4566 - RNA, 21 nt, Homo sapiens
aggagcuccgcgcuggcagcu

SEQ ID NO: 4567 - RNA, 21 nt, Homo sapiens
ggagcuccgcgcuggcagcug

SEQ ID NO: 4568 - RNA, 21 nt, Homo sapiens
gagcuccgcgcuggcagcugg

SEQ ID NO: 4569 - RNA, 21 nt, Homo sapiens
agcuccgcgcuggcagcuggg

SEQ ID NO: 4570 - RNA, 21 nt, Homo sapiens
gcuccgcgcuggcagcuggga

SEQ ID NO: 4571 - RNA, 21 nt, Homo sapiens
cuccgcgcuggcagcugggag

SEQ ID NO: 4572 - RNA, 21 nt, Homo sapiens
uccgcgcuggcagcugggagg

SEQ ID NO: 4573 - RNA, 21 nt, Homo sapiens
ccgcgcuggcagcugggaggc

SEQ ID NO: 4574 - RNA, 21 nt, Homo sapiens
cgcgcuggcagcugggaggcu

SEQ ID NO: 4575 - RNA, 21 nt, Homo sapiens
gcgcuggcagcugggaggcug

SEQ ID NO: 4576 - RNA, 21 nt, Homo sapiens
cgcuggcagcugggaggcugc

SEQ ID NO: 4577 - RNA, 21 nt, Homo sapiens
gcuggcagcugggaggcugca

SEQ ID NO: 4578 - RNA, 21 nt, Homo sapiens
cuggcagcugggaggcugcag

SEQ ID NO: 4579 - RNA, 21 nt, Homo sapiens
uggcagcugggaggcugcagg

SEQ ID NO: 4580 - RNA, 21 nt, Homo sapiens
ggcagcugggaggcugcaggg

SEQ ID NO: 4581 - RNA, 21 nt, Homo sapiens
gcagcugggaggcugcagggg

SEQ ID NO: 4582 - RNA, 21 nt, Homo sapiens
cagcugggaggcugcaggggc

SEQ ID NO: 4583 - RNA, 21 nt, Homo sapiens
agcugggaggcugcaggggcc

SEQ ID NO: 4584 - RNA, 21 nt, Homo sapiens
gcugggaggcugcaggggccc

SEQ ID NO: 4585 - RNA, 21 nt, Homo sapiens
cugggaggcugcaggggcccg

SEQ ID NO: 4586 - RNA, 21 nt, Homo sapiens
ugggaggcugcaggggcccgg

SEQ ID NO: 4587 - RNA, 21 nt, Homo sapiens
gggaggcugcaggggcccggg

SEQ ID NO: 4588 - RNA, 21 nt, Homo sapiens
ggaggcugcaggggcccgggc

SEQ ID NO: 4589 - RNA, 21 nt, Homo sapiens
gaggcugcaggggcccgggcg

SEQ ID NO: 4590 - RNA, 21 nt, Homo sapiens
aggcugcaggggcccgggcgg

SEQ ID NO: 4591 - RNA, 21 nt, Homo sapiens
ggcugcaggggcccgggcggg

SEQ ID NO: 4592 - RNA, 21 nt, Homo sapiens
gcugcaggggcccgggcgggc

SEQ ID NO: 4593 - RNA, 21 nt, Homo sapiens
cugcaggggcccgggcgggcg

SEQ ID NO: 4594 - RNA, 21 nt, Homo sapiens
ugcaggggcccgggcgggcgg

SEQ ID NO: 4595 - RNA, 21 nt, Homo sapiens
gcaggggcccgggcgggcggg

SEQ ID NO: 4596 - RNA, 21 nt, Homo sapiens
caggggcccgggcgggcgggc

SEQ ID NO: 4597 - RNA, 21 nt, Homo sapiens
aggggcccgggcgggcgggcg

SEQ ID NO: 4598 - RNA, 21 nt, Homo sapiens
ggggcccgggcgggcgggcga

SEQ ID NO: 4599 - RNA, 21 nt, Homo sapiens
gggcccgggcgggcgggcgac

SEQ ID NO: 4600 - RNA, 21 nt, Homo sapiens
ggcccgggcgggcgggcgacg

SEQ ID NO: 4601 - RNA, 21 nt, Homo sapiens
gcccgggcgggcgggcgacgg

SEQ ID NO: 4602 - RNA, 21 nt, Homo sapiens
cccgggcgggcgggcgacggu

SEQ ID NO: 4603 - RNA, 21 nt, Homo sapiens
ccgggcgggcgggcgacggug

SEQ ID NO: 4604 - RNA, 21 nt, Homo sapiens
cgggcgggcgggcgacggugg

SEQ ID NO: 4605 - RNA, 21 nt, Homo sapiens
gggcgggcgggcgacgguggc

SEQ ID NO: 4606 - RNA, 21 nt, Homo sapiens
ggcgggcgggcgacgguggcg

SEQ ID NO: 4607 - RNA, 21 nt, Homo sapiens
gcgggcgggcgacgguggcgc

SEQ ID NO: 4608 - RNA, 21 nt, Homo sapiens
cgggcgggcgacgguggcgcg

SEQ ID NO: 4609 - RNA, 21 nt, Homo sapiens
gggcgggcgacgguggcgcgg

SEQ ID NO: 4610 - RNA, 21 nt, Homo sapiens
ggcgggcgacgguggcgcggg

SEQ ID NO: 4611 - RNA, 21 nt, Homo sapiens
gcgggcgacgguggcgcgggg

SEQ ID NO: 4612 - RNA, 21 nt, Homo sapiens
cgggcgacgguggcgcggggg

SEQ ID NO: 4613 - RNA, 21 nt, Homo sapiens
gggcgacgguggcgcgggggc

SEQ ID NO: 4614 - RNA, 21 nt, Homo sapiens
ggcgacgguggcgcgggggca

SEQ ID NO: 4615 - RNA, 21 nt, Homo sapiens
gcgacgguggcgcgggggcac

SEQ ID NO: 4616 - RNA, 21 nt, Homo sapiens
cgacgguggcgcgggggcaca

SEQ ID NO: 4617 - RNA, 21 nt, Homo sapiens
gacgguggcgcgggggcacac

SEQ ID NO: 4618 - RNA, 21 nt, Homo sapiens
acgguggcgcgggggcacaca

SEQ ID NO: 4619 - RNA, 21 nt, Homo sapiens
cgguggcgcgggggcacacag

SEQ ID NO: 4620 - RNA, 21 nt, Homo sapiens
gguggcgcgggggcacacagg

SEQ ID NO: 4621 - RNA, 21 nt, Homo sapiens
guggcgcgggggcacacagga

SEQ ID NO: 4622 - RNA, 21 nt, Homo sapiens
uggcgcgggggcacacaggag

SEQ ID NO: 4623 - RNA, 21 nt, Homo sapiens
ggcgcgggggcacacaggagg

SEQ ID NO: 4624 - RNA, 21 nt, Homo sapiens
gcgcgggggcacacaggaggc

SEQ ID NO: 4625 - RNA, 21 nt, Homo sapiens
cgcgggggcacacaggaggcg

SEQ ID NO: 4626 - RNA, 21 nt, Homo sapiens
gcgggggcacacaggaggcga

SEQ ID NO: 4627 - RNA, 21 nt, Homo sapiens
cgggggcacacaggaggcgag

SEQ ID NO: 4628 - RNA, 21 nt, Homo sapiens
gggggcacacaggaggcgagc

SEQ ID NO: 4629 - RNA, 21 nt, Homo sapiens
ggggcacacaggaggcgagcc

SEQ ID NO: 4630 - RNA, 21 nt, Homo sapiens
gggcacacaggaggcgagccg

SEQ ID NO: 4631 - RNA, 21 nt, Homo sapiens
ggcacacaggaggcgagccgc

SEQ ID NO: 4632 - RNA, 21 nt, Homo sapiens
gcacacaggaggcgagccgcc

SEQ ID NO: 4633 - RNA, 21 nt, Homo sapiens
cacacaggaggcgagccgccg

SEQ ID NO: 4634 - RNA, 21 nt, Homo sapiens
acacaggaggcgagccgccgg

SEQ ID NO: 4635 - RNA, 21 nt, Homo sapiens
cacaggaggcgagccgccgga

SEQ ID NO: 4636 - RNA, 21 nt, Homo sapiens
acaggaggcgagccgccggag

SEQ ID NO: 4637 - RNA, 21 nt, Homo sapiens
caggaggcgagccgccggagc

SEQ ID NO: 4638 - RNA, 21 nt, Homo sapiens
aggaggcgagccgccggagcg

SEQ ID NO: 4639 - RNA, 21 nt, Homo sapiens
ggaggcgagccgccggagcgg

SEQ ID NO: 4640 - RNA, 21 nt, Homo sapiens
gaggcgagccgccggagcgga

SEQ ID NO: 4641 - RNA, 21 nt, Homo sapiens
aggcgagccgccggagcggag

SEQ ID NO: 4642 - RNA, 21 nt, Homo sapiens
ggcgagccgccggagcggagu

SEQ ID NO: 4643 - RNA, 21 nt, Homo sapiens
gcgagccgccggagcggaguc

SEQ ID NO: 4644 - RNA, 21 nt, Homo sapiens
cgagccgccggagcggaguca

SEQ ID NO: 4645 - RNA, 21 nt, Homo sapiens
gagccgccggagcggagucag

SEQ ID NO: 4646 - RNA, 21 nt, Homo sapiens
agccgccggagcggagucagg

SEQ ID NO: 4647 - RNA, 21 nt, Homo sapiens
gccgccggagcggagucaggc

SEQ ID NO: 4648 - RNA, 21 nt, Homo sapiens
ccgccggagcggagucaggcc

SEQ ID NO: 4649 - RNA, 21 nt, Homo sapiens
cgccggagcggagucaggccc

SEQ ID NO: 4650 - RNA, 21 nt, Homo sapiens
gccggagcggagucaggcccg

SEQ ID NO: 4651 - RNA, 21 nt, Homo sapiens
ccggagcggagucaggcccgg

SEQ ID NO: 4652 - RNA, 21 nt, Homo sapiens
cggagcggagucaggcccgga

SEQ ID NO: 4653 - RNA, 21 nt, Homo sapiens
ggagcggagucaggcccggac

SEQ ID NO: 4654 - RNA, 21 nt, Homo sapiens
gagcggagucaggcccggacg

SEQ ID NO: 4655 - RNA, 21 nt, Homo sapiens
agcggagucaggcccggacgc

SEQ ID NO: 4656 - RNA, 21 nt, Homo sapiens
gcggagucaggcccggacgcu

SEQ ID NO: 4657 - RNA, 21 nt, Homo sapiens
cggagucaggcccggacgcug

SEQ ID NO: 4658 - RNA, 21 nt, Homo sapiens
ggagucaggcccggacgcugc

SEQ ID NO: 4659 - RNA, 21 nt, Homo sapiens
gagucaggcccggacgcugcg

SEQ ID NO: 4660 - RNA, 21 nt, Homo sapiens
agucaggcccggacgcugcgc

SEQ ID NO: 4661 - RNA, 21 nt, Homo sapiens
gucaggcccggacgcugcgcg

SEQ ID NO: 4662 - RNA, 21 nt, Homo sapiens
ucaggcccggacgcugcgcgg

SEQ ID NO: 4663 - RNA, 21 nt, Homo sapiens
caggcccggacgcugcgcggg

SEQ ID NO: 4664 - RNA, 21 nt, Homo sapiens
aggcccggacgcugcgcgggg

SEQ ID NO: 4665 - RNA, 21 nt, Homo sapiens
ggcccggacgcugcgcggggc

SEQ ID NO: 4666 - RNA, 21 nt, Homo sapiens
gcccggacgcugcgcggggcc

SEQ ID NO: 4667 - RNA, 21 nt, Homo sapiens
cccggacgcugcgcggggccc

SEQ ID NO: 4668 - RNA, 21 nt, Homo sapiens
ccggacgcugcgcggggcccg

SEQ ID NO: 4669 - RNA, 21 nt, Homo sapiens
cggacgcugcgcggggcccgg

SEQ ID NO: 4670 - RNA, 21 nt, Homo sapiens
ggacgcugcgcggggcccggu

SEQ ID NO: 4671 - RNA, 21 nt, Homo sapiens
gacgcugcgcggggcccggug

SEQ ID NO: 4672 - RNA, 21 nt, Homo sapiens
acgcugcgcggggcccggugu

SEQ ID NO: 4673 - RNA, 21 nt, Homo sapiens
cgcugcgcggggcccgguguu

SEQ ID NO: 4674 - RNA, 21 nt, Homo sapiens
gcugcgcggggcccgguguuu

SEQ ID NO: 4675 - RNA, 21 nt, Homo sapiens
cugcgcggggcccgguguuuc

SEQ ID NO: 4676 - RNA, 21 nt, Homo sapiens
ugcgcggggcccgguguuucg

SEQ ID NO: 4677 - RNA, 21 nt, Homo sapiens
gcgcggggcccgguguuucgc

SEQ ID NO: 4678 - RNA, 21 nt, Homo sapiens
cgcggggcccgguguuucgcg

SEQ ID NO: 4679 - RNA, 21 nt, Homo sapiens
gcggggcccgguguuucgcgg

SEQ ID NO: 4680 - RNA, 21 nt, Homo sapiens
cggggcccgguguuucgcggg

SEQ ID NO: 4681 - RNA, 21 nt, Homo sapiens
ggggcccgguguuucgcggga

SEQ ID NO: 4682 - RNA, 21 nt, Homo sapiens
gggcccgguguuucgcgggac

SEQ ID NO: 4683 - RNA, 21 nt, Homo sapiens
ggcccgguguuucgcgggacg

SEQ ID NO: 4684 - RNA, 21 nt, Homo sapiens
gcccgguguuucgcgggacgg

SEQ ID NO: 4685 - RNA, 21 nt, Homo sapiens
cccgguguuucgcgggacggg

SEQ ID NO: 4686 - RNA, 21 nt, Homo sapiens
ccgguguuucgcgggacgggg

SEQ ID NO: 4687 - RNA, 21 nt, Homo sapiens
cgguguuucgcgggacggggg

SEQ ID NO: 4688 - RNA, 21 nt, Homo sapiens
gguguuucgcgggacgggggu

SEQ ID NO: 4689 - RNA, 21 nt, Homo sapiens
guguuucgcgggacggggguc

SEQ ID NO: 4690 - RNA, 21 nt, Homo sapiens
uguuucgcgggacgggggucu

SEQ ID NO: 4691 - RNA, 21 nt, Homo sapiens
guuucgcgggacgggggucuc

SEQ ID NO: 4692 - RNA, 21 nt, Homo sapiens
uuucgcgggacgggggucucc

SEQ ID NO: 4693 - RNA, 21 nt, Homo sapiens
uucgcgggacgggggucucca

SEQ ID NO: 4694 - RNA, 21 nt, Homo sapiens
ucgcgggacgggggucuccac

SEQ ID NO: 4695 - RNA, 21 nt, Homo sapiens
cgcgggacgggggucuccacc

SEQ ID NO: 4696 - RNA, 21 nt, Homo sapiens
gcgggacgggggucuccaccc

SEQ ID NO: 4697 - RNA, 21 nt, Homo sapiens
cgggacgggggucuccaccca

SEQ ID NO: 4698 - RNA, 21 nt, Homo sapiens
gggacgggggucuccacccag

SEQ ID NO: 4699 - RNA, 21 nt, Homo sapiens
ggacgggggucuccacccagc

SEQ ID NO: 4700 - RNA, 21 nt, Homo sapiens
gacgggggucuccacccagcc

SEQ ID NO: 4701 - RNA, 21 nt, Homo sapiens
acgggggucuccacccagccc

SEQ ID NO: 4702 - RNA, 21 nt, Homo sapiens
cgggggucuccacccagccca

SEQ ID NO: 4703 - RNA, 21 nt, Homo sapiens
gggggucuccacccagcccag

SEQ ID NO: 4704 - RNA, 21 nt, Homo sapiens
ggggucuccacccagcccagg

SEQ ID NO: 4705 - RNA, 21 nt, Homo sapiens
gggucuccacccagcccaggg

SEQ ID NO: 4706 - RNA, 21 nt, Homo sapiens
ggucuccacccagcccagggg

SEQ ID NO: 4707 - RNA, 21 nt, Homo sapiens
gucuccacccagcccagggga

SEQ ID NO: 4708 - RNA, 21 nt, Homo sapiens
ucuccacccagcccaggggac

SEQ ID NO: 4709 - RNA, 21 nt, Homo sapiens
cuccacccagcccaggggacg

SEQ ID NO: 4710 - RNA, 21 nt, Homo sapiens
uccacccagcccaggggacga

SEQ ID NO: 4711 - RNA, 21 nt, Homo sapiens
ccacccagcccaggggacgac

SEQ ID NO: 4712 - RNA, 21 nt, Homo sapiens
cacccagcccaggggacgacg

SEQ ID NO: 4713 - RNA, 21 nt, Homo sapiens
acccagcccaggggacgacgc

SEQ ID NO: 4714 - RNA, 21 nt, Homo sapiens
cccagcccaggggacgacgcg

SEQ ID NO: 4715 - RNA, 21 nt, Homo sapiens
ccagcccaggggacgacgcgu

SEQ ID NO: 4716 - RNA, 21 nt, Homo sapiens
cagcccaggggacgacgcguu

SEQ ID NO: 4717 - RNA, 21 nt, Homo sapiens
agcccaggggacgacgcguuu

SEQ ID NO: 4718 - RNA, 21 nt, Homo sapiens
gcccaggggacgacgcguuuu

SEQ ID NO: 4719 - RNA, 21 nt, Homo sapiens
cccaggggacgacgcguuuuc

SEQ ID NO: 4720 - RNA, 21 nt, Homo sapiens
ccaggggacgacgcguuuucc

SEQ ID NO: 4721 - RNA, 21 nt, Homo sapiens
caggggacgacgcguuuuccg

SEQ ID NO: 4722 - RNA, 21 nt, Homo sapiens
aggggacgacgcguuuuccgg

SEQ ID NO: 4723 - RNA, 21 nt, Homo sapiens
ggggacgacgcguuuuccggg

SEQ ID NO: 4724 - RNA, 21 nt, Homo sapiens
gggacgacgcguuuuccgggg

SEQ ID NO: 4725 - RNA, 21 nt, Homo sapiens
ggacgacgcguuuuccggggg

SEQ ID NO: 4726 - RNA, 21 nt, Homo sapiens
gacgacgcguuuuccgggggu

SEQ ID NO: 4727 - RNA, 21 nt, Homo sapiens
acgacgcguuuuccgggggug

SEQ ID NO: 4728 - RNA, 21 nt, Homo sapiens
cgacgcguuuuccgggggugg

SEQ ID NO: 4729 - RNA, 21 nt, Homo sapiens
gacgcguuuuccggggguggg

SEQ ID NO: 4730 - RNA, 21 nt, Homo sapiens
acgcguuuuccgggggugggg

SEQ ID NO: 4731 - RNA, 21 nt, Homo sapiens
cgcguuuuccggggguggggg

SEQ ID NO: 4732 - RNA, 21 nt, Homo sapiens
gcguuuuccgggggugggggg

SEQ ID NO: 4733 - RNA, 21 nt, Homo sapiens
cguuuuccggggguggggggu

SEQ ID NO: 4734 - RNA, 21 nt, Homo sapiens
guuuuccggggguggggggug

SEQ ID NO: 4735 - RNA, 21 nt, Homo sapiens
uuuuccggggguggggggugg

SEQ ID NO: 4736 - RNA, 21 nt, Homo sapiens
uuuccgggggugggggguggg

SEQ ID NO: 4737 - RNA, 21 nt, Homo sapiens
uuccggggguggggggugggg

SEQ ID NO: 4738 - RNA, 21 nt, Homo sapiens
uccgggggugggggguggggg

SEQ ID NO: 4739 - RNA, 21 nt, Homo sapiens
ccggggguggggggugggggg

SEQ ID NO: 4740 - RNA, 21 nt, Homo sapiens
cgggggugggggguggggggu

SEQ ID NO: 4741 - RNA, 21 nt, Homo sapiens
gggggugggggguggggggug

SEQ ID NO: 4742 - RNA, 21 nt, Homo sapiens
ggggugggggguggggggugg

SEQ ID NO: 4743 - RNA, 21 nt, Homo sapiens
ggguggggggugggggguggg

SEQ ID NO: 4744 - RNA, 21 nt, Homo sapiens
ggugggggguggggggugggg

SEQ ID NO: 4745 - RNA, 21 nt, Homo sapiens
gugggggguggggggugggga

SEQ ID NO: 4746 - RNA, 21 nt, Homo sapiens
uggggggugggggguggggag

SEQ ID NO: 4747 - RNA, 21 nt, Homo sapiens
ggggggugggggguggggagg

SEQ ID NO: 4748 - RNA, 21 nt, Homo sapiens
gggggugggggguggggaggg

SEQ ID NO: 4749 - RNA, 21 nt, Homo sapiens
ggggugggggguggggagggg

SEQ ID NO: 4750 - RNA, 21 nt, Homo sapiens
gggugggggguggggaggggg

SEQ ID NO: 4751 - RNA, 21 nt, Homo sapiens
ggugggggguggggagggggc

SEQ ID NO: 4752 - RNA, 21 nt, Homo sapiens
gugggggguggggagggggcg

SEQ ID NO: 4753 - RNA, 21 nt, Homo sapiens
ugggggguggggagggggcgg

SEQ ID NO: 4754 - RNA, 21 nt, Homo sapiens
gggggguggggagggggcggu

SEQ ID NO: 4755 - RNA, 21 nt, Homo sapiens
ggggguggggagggggcgguc

SEQ ID NO: 4756 - RNA, 21 nt, Homo sapiens
gggguggggagggggcgguca

SEQ ID NO: 4757 - RNA, 21 nt, Homo sapiens
ggguggggagggggcggucag

SEQ ID NO: 4758 - RNA, 21 nt, Homo sapiens
gguggggagggggcggucagg

SEQ ID NO: 4759 - RNA, 21 nt, Homo sapiens
guggggagggggcggucaggc

SEQ ID NO: 4760 - RNA, 21 nt, Homo sapiens
uggggagggggcggucaggcg

SEQ ID NO: 4761 - RNA, 21 nt, Homo sapiens
ggggagggggcggucaggcgg

SEQ ID NO: 4762 - RNA, 21 nt, Homo sapiens
gggagggggcggucaggcggc

SEQ ID NO: 4763 - RNA, 21 nt, Homo sapiens
ggagggggcggucaggcggcg

SEQ ID NO: 4764 - RNA, 21 nt, Homo sapiens
gagggggcggucaggcggcgg

SEQ ID NO: 4765 - RNA, 21 nt, Homo sapiens
agggggcggucaggcggcggg

SEQ ID NO: 4766 - RNA, 21 nt, Homo sapiens
gggggcggucaggcggcgggg

SEQ ID NO: 4767 - RNA, 21 nt, Homo sapiens
ggggcggucaggcggcggggu

SEQ ID NO: 4768 - RNA, 21 nt, Homo sapiens
gggcggucaggcggcggggug

SEQ ID NO: 4769 - RNA, 21 nt, Homo sapiens
ggcggucaggcggcggggugg

SEQ ID NO: 4770 - RNA, 21 nt, Homo sapiens
gcggucaggcggcgggguggg

SEQ ID NO: 4771 - RNA, 21 nt, Homo sapiens
cggucaggcggcggggugggc

SEQ ID NO: 4772 - RNA, 21 nt, Homo sapiens
ggucaggcggcggggugggcu

SEQ ID NO: 4773 - RNA, 21 nt, Homo sapiens
gucaggcggcggggugggcug

SEQ ID NO: 4774 - RNA, 21 nt, Homo sapiens
ucaggcggcggggugggcugg

SEQ ID NO: 4775 - RNA, 21 nt, Homo sapiens
caggcggcggggugggcuggu

SEQ ID NO: 4776 - RNA, 21 nt, Homo sapiens
aggcggcggggugggcuggug

SEQ ID NO: 4777 - RNA, 21 nt, Homo sapiens
ggcggcggggugggcuggugg

SEQ ID NO: 4778 - RNA, 21 nt, Homo sapiens
gcggcggggugggcuggugga

SEQ ID NO: 4779 - RNA, 21 nt, Homo sapiens
cggcggggugggcugguggag

SEQ ID NO: 4780 - RNA, 21 nt, Homo sapiens
ggcggggugggcugguggaga

SEQ ID NO: 4781 - RNA, 21 nt, Homo sapiens
gcggggugggcugguggagag

SEQ ID NO: 4782 - RNA, 21 nt, Homo sapiens
cggggugggcugguggagagg

SEQ ID NO: 4783 - RNA, 21 nt, Homo sapiens
ggggugggcugguggagaggc

SEQ ID NO: 4784 - RNA, 21 nt, Homo sapiens
gggugggcugguggagaggca

SEQ ID NO: 4785 - RNA, 21 nt, Homo sapiens
ggugggcugguggagaggcag

SEQ ID NO: 4786 - RNA, 21 nt, Homo sapiens
gugggcugguggagaggcagg

SEQ ID NO: 4787 - RNA, 21 nt, Homo sapiens
ugggcugguggagaggcagga

SEQ ID NO: 4788 - RNA, 21 nt, Homo sapiens
gggcugguggagaggcaggag

SEQ ID NO: 4789 - RNA, 21 nt, Homo sapiens
ggcugguggagaggcaggaga

SEQ ID NO: 4790 - RNA, 21 nt, Homo sapiens
gcugguggagaggcaggagag

SEQ ID NO: 4791 - RNA, 21 nt, Homo sapiens
cugguggagaggcaggagagc

SEQ ID NO: 4792 - RNA, 21 nt, Homo sapiens
ugguggagaggcaggagagcu

SEQ ID NO: 4793 - RNA, 21 nt, Homo sapiens
gguggagaggcaggagagcuc

SEQ ID NO: 4794 - RNA, 21 nt, Homo sapiens
guggagaggcaggagagcucu

SEQ ID NO: 4795 - RNA, 21 nt, Homo sapiens
uggagaggcaggagagcucug

SEQ ID NO: 4796 - RNA, 21 nt, Homo sapiens
ggagaggcaggagagcucugc

SEQ ID NO: 4797 - RNA, 21 nt, Homo sapiens
gagaggcaggagagcucugcc

SEQ ID NO: 4798 - RNA, 21 nt, Homo sapiens
agaggcaggagagcucugccc

SEQ ID NO: 4799 - RNA, 21 nt, Homo sapiens
gaggcaggagagcucugcccg

SEQ ID NO: 4800 - RNA, 21 nt, Homo sapiens
aggcaggagagcucugcccgg

SEQ ID NO: 4801 - RNA, 21 nt, Homo sapiens
ggcaggagagcucugcccggg

SEQ ID NO: 4802 - RNA, 21 nt, Homo sapiens
gcaggagagcucugcccgggc

SEQ ID NO: 4803 - RNA, 21 nt, Homo sapiens
caggagagcucugcccgggcu

SEQ ID NO: 4804 - RNA, 21 nt, Homo sapiens
aggagagcucugcccgggcug

SEQ ID NO: 4805 - RNA, 21 nt, Homo sapiens
ggagagcucugcccgggcugc

SEQ ID NO: 4806 - RNA, 21 nt, Homo sapiens
gagagcucugcccgggcugcu

SEQ ID NO: 4807 - RNA, 21 nt, Homo sapiens
agagcucugcccgggcugcuc

SEQ ID NO: 4808 - RNA, 21 nt, Homo sapiens
gagcucugcccgggcugcucc

SEQ ID NO: 4809 - RNA, 21 nt, Homo sapiens
agcucugcccgggcugcuccc

SEQ ID NO: 4810 - RNA, 21 nt, Homo sapiens
gcucugcccgggcugcuccca

SEQ ID NO: 4811 - RNA, 21 nt, Homo sapiens
cucugcccgggcugcucccac

SEQ ID NO: 4812 - RNA, 21 nt, Homo sapiens
ucugcccgggcugcucccaca

SEQ ID NO: 4813 - RNA, 21 nt, Homo sapiens
cugcccgggcugcucccacag

SEQ ID NO: 4814 - RNA, 21 nt, Homo sapiens
ugcccgggcugcucccacagc

SEQ ID NO: 4815 - RNA, 21 nt, Homo sapiens
gcccgggcugcucccacagcc

SEQ ID NO: 4816 - RNA, 21 nt, Homo sapiens
cccgggcugcucccacagccc

SEQ ID NO: 4817 - RNA, 21 nt, Homo sapiens
ccgggcugcucccacagccca

SEQ ID NO: 4818 - RNA, 21 nt, Homo sapiens
cgggcugcucccacagcccag

SEQ ID NO: 4819 - RNA, 21 nt, Homo sapiens
gggcugcucccacagcccagg

SEQ ID NO: 4820 - RNA, 21 nt, Homo sapiens
ggcugcucccacagcccaggc

SEQ ID NO: 4821 - RNA, 21 nt, Homo sapiens
gcugcucccacagcccaggcg

SEQ ID NO: 4822 - RNA, 21 nt, Homo sapiens
cugcucccacagcccaggcgg

SEQ ID NO: 4823 - RNA, 21 nt, Homo sapiens
ugcucccacagcccaggcggc

SEQ ID NO: 4824 - RNA, 21 nt, Homo sapiens
gcucccacagcccaggcggcu

SEQ ID NO: 4825 - RNA, 21 nt, Homo sapiens
cucccacagcccaggcggcug

SEQ ID NO: 4826 - RNA, 21 nt, Homo sapiens
ucccacagcccaggcggcugc

SEQ ID NO: 4827 - RNA, 21 nt, Homo sapiens
cccacagcccaggcggcugcc

SEQ ID NO: 4828 - RNA, 21 nt, Homo sapiens
ccacagcccaggcggcugccc

SEQ ID NO: 4829 - RNA, 21 nt, Homo sapiens
cacagcccaggcggcugcccg

SEQ ID NO: 4830 - RNA, 21 nt, Homo sapiens
acagcccaggcggcugcccgc

SEQ ID NO: 4831 - RNA, 21 nt, Homo sapiens
cagcccaggcggcugcccgca

SEQ ID NO: 4832 - RNA, 21 nt, Homo sapiens
agcccaggcggcugcccgcaa

SEQ ID NO: 4833 - RNA, 21 nt, Homo sapiens
gcccaggcggcugcccgcaaa

SEQ ID NO: 4834 - RNA, 21 nt, Homo sapiens
cccaggcggcugcccgcaaac

SEQ ID NO: 4835 - RNA, 21 nt, Homo sapiens
ccaggcggcugcccgcaaacc

SEQ ID NO: 4836 - RNA, 21 nt, Homo sapiens
caggcggcugcccgcaaaccc

SEQ ID NO: 4837 - RNA, 21 nt, Homo sapiens
aggcggcugcccgcaaacccg

SEQ ID NO: 4838 - RNA, 21 nt, Homo sapiens
ggcggcugcccgcaaacccgc

SEQ ID NO: 4839 - RNA, 21 nt, Homo sapiens
gcggcugcccgcaaacccgcg

SEQ ID NO: 4840 - RNA, 21 nt, Homo sapiens
cggcugcccgcaaacccgcgc

SEQ ID NO: 4841 - RNA, 21 nt, Homo sapiens
ggcugcccgcaaacccgcgcg

SEQ ID NO: 4842 - RNA, 21 nt, Homo sapiens
gcugcccgcaaacccgcgcgu

SEQ ID NO: 4843 - RNA, 21 nt, Homo sapiens
cugcccgcaaacccgcgcgug

SEQ ID NO: 4844 - RNA, 21 nt, Homo sapiens
ugcccgcaaacccgcgcgugc

SEQ ID NO: 4845 - RNA, 21 nt, Homo sapiens
gcccgcaaacccgcgcgugcg

SEQ ID NO: 4846 - RNA, 21 nt, Homo sapiens
cccgcaaacccgcgcgugcgc

SEQ ID NO: 4847 - RNA, 21 nt, Homo sapiens
ccgcaaacccgcgcgugcgca

SEQ ID NO: 4848 - RNA, 21 nt, Homo sapiens
cgcaaacccgcgcgugcgcag

SEQ ID NO: 4849 - RNA, 21 nt, Homo sapiens
gcaaacccgcgcgugcgcagu

SEQ ID NO: 4850 - RNA, 21 nt, Homo sapiens
caaacccgcgcgugcgcagua

SEQ ID NO: 4851 - RNA, 21 nt, Homo sapiens
aaacccgcgcgugcgcaguag

SEQ ID NO: 4852 - RNA, 21 nt, Homo sapiens
aacccgcgcgugcgcaguagg

SEQ ID NO: 4853 - RNA, 21 nt, Homo sapiens
acccgcgcgugcgcaguaggc

SEQ ID NO: 4854 - RNA, 21 nt, Homo sapiens
cccgcgcgugcgcaguaggcg

SEQ ID NO: 4855 - RNA, 21 nt, Homo sapiens
ccgcgcgugcgcaguaggcgg

SEQ ID NO: 4856 - RNA, 21 nt, Homo sapiens
cgcgcgugcgcaguaggcggc

SEQ ID NO: 4857 - RNA, 21 nt, Homo sapiens
gcgcgugcgcaguaggcggcc

SEQ ID NO: 4858 - RNA, 21 nt, Homo sapiens
cgcgugcgcaguaggcggccc

SEQ ID NO: 4859 - RNA, 21 nt, Homo sapiens
gcgugcgcaguaggcggccca

SEQ ID NO: 4860 - RNA, 21 nt, Homo sapiens
cgugcgcaguaggcggcccac

SEQ ID NO: 4861 - RNA, 21 nt, Homo sapiens
gugcgcaguaggcggcccacc

SEQ ID NO: 4862 - RNA, 21 nt, Homo sapiens
ugcgcaguaggcggcccaccu

SEQ ID NO: 4863 - RNA, 21 nt, Homo sapiens
gcgcaguaggcggcccaccug

SEQ ID NO: 4864 - RNA, 21 nt, Homo sapiens
cgcaguaggcggcccaccugc

SEQ ID NO: 4865 - RNA, 21 nt, Homo sapiens
gcaguaggcggcccaccugcu

SEQ ID NO: 4866 - RNA, 21 nt, Homo sapiens
caguaggcggcccaccugcug

SEQ ID NO: 4867 - RNA, 21 nt, Homo sapiens
aguaggcggcccaccugcugg

SEQ ID NO: 4868 - RNA, 21 nt, Homo sapiens
guaggcggcccaccugcuggu

SEQ ID NO: 4869 - RNA, 21 nt, Homo sapiens
uaggcggcccaccugcuggua

SEQ ID NO: 4870 - RNA, 21 nt, Homo sapiens
aggcggcccaccugcugguac

SEQ ID NO: 4871 - RNA, 21 nt, Homo sapiens
ggcggcccaccugcugguacc

SEQ ID NO: 4872 - RNA, 21 nt, Homo sapiens
gcggcccaccugcugguaccu

SEQ ID NO: 4873 - RNA, 21 nt, Homo sapiens
cggcccaccugcugguaccug

SEQ ID NO: 4874 - RNA, 21 nt, Homo sapiens
ggcccaccugcugguaccugg

SEQ ID NO: 4875 - RNA, 21 nt, Homo sapiens
gcccaccugcugguaccuggg

SEQ ID NO: 4876 - RNA, 21 nt, Homo sapiens
cccaccugcugguaccugggc

SEQ ID NO: 4877 - RNA, 21 nt, Homo sapiens
ccaccugcugguaccugggcc

SEQ ID NO: 4878 - RNA, 21 nt, Homo sapiens
caccugcugguaccugggccg

SEQ ID NO: 4879 - RNA, 21 nt, Homo sapiens
accugcugguaccugggccgg

SEQ ID NO: 4880 - RNA, 21 nt, Homo sapiens
ccugcugguaccugggccggc

SEQ ID NO: 4881 - RNA, 21 nt, Homo sapiens
cugcugguaccugggccggcu

SEQ ID NO: 4882 - RNA, 21 nt, Homo sapiens
ugcugguaccugggccggcuc

SEQ ID NO: 4883 - RNA, 21 nt, Homo sapiens
gcugguaccugggccggcucu

SEQ ID NO: 4884 - RNA, 21 nt, Homo sapiens
cugguaccugggccggcucug

SEQ ID NO: 4885 - RNA, 21 nt, Homo sapiens
ugguaccugggccggcucugg

SEQ ID NO: 4886 - RNA, 21 nt, Homo sapiens
gguaccugggccggcucuggg

SEQ ID NO: 4887 - RNA, 21 nt, Homo sapiens
guaccugggccggcucuggga

SEQ ID NO: 4888 - RNA, 21 nt, Homo sapiens
uaccugggccggcucugggau

SEQ ID NO: 4889 - RNA, 21 nt, Homo sapiens
accugggccggcucugggauc

SEQ ID NO: 4890 - RNA, 21 nt, Homo sapiens
ccugggccggcucugggaucc

SEQ ID NO: 4891 - RNA, 21 nt, Homo sapiens
cugggccggcucugggauccc

SEQ ID NO: 4892 - RNA, 21 nt, Homo sapiens
ugggccggcucugggaucccc

SEQ ID NO: 4893 - RNA, 21 nt, Homo sapiens
gggccggcucugggauccccg

SEQ ID NO: 4894 - RNA, 21 nt, Homo sapiens
ggccggcucugggauccccgg

SEQ ID NO: 4895 - RNA, 21 nt, Homo sapiens
gccggcucugggauccccggg

SEQ ID NO: 4896 - RNA, 21 nt, Homo sapiens
ccggcucugggauccccggga

SEQ ID NO: 4897 - RNA, 21 nt, Homo sapiens
cggcucugggauccccgggau

SEQ ID NO: 4898 - RNA, 21 nt, Homo sapiens
ggcucugggauccccgggaug

SEQ ID NO: 4899 - RNA, 21 nt, Homo sapiens
gcucugggauccccgggaugc

SEQ ID NO: 4900 - RNA, 21 nt, Homo sapiens
cucugggauccccgggaugcc

SEQ ID NO: 4901 - RNA, 21 nt, Homo sapiens
ucugggauccccgggaugccc

SEQ ID NO: 4902 - RNA, 21 nt, Homo sapiens
cugggauccccgggaugccca

SEQ ID NO: 4903 - RNA, 21 nt, Homo sapiens
ugggauccccgggaugcccag

SEQ ID NO: 4904 - RNA, 21 nt, Homo sapiens
gggauccccgggaugcccagg

SEQ ID NO: 4905 - RNA, 21 nt, Homo sapiens
ggauccccgggaugcccagga

SEQ ID NO: 4906 - RNA, 21 nt, Homo sapiens
gauccccgggaugcccaggaa

SEQ ID NO: 4907 - RNA, 21 nt, Homo sapiens
auccccgggaugcccaggaaa

SEQ ID NO: 4908 - RNA, 21 nt, Homo sapiens
uccccgggaugcccaggaaag

SEQ ID NO: 4909 - RNA, 21 nt, Homo sapiens
ccccgggaugcccaggaaaga

SEQ ID NO: 4910 - RNA, 21 nt, Homo sapiens
cccgggaugcccaggaaagaa

SEQ ID NO: 4911 - RNA, 21 nt, Homo sapiens
ccgggaugcccaggaaagaau

SEQ ID NO: 4912 - RNA, 21 nt, Homo sapiens
cgggaugcccaggaaagaaug

SEQ ID NO: 4913 - RNA, 21 nt, Homo sapiens
gggaugcccaggaaagaaugg

SEQ ID NO: 4914 - RNA, 21 nt, Homo sapiens
ggaugcccaggaaagaauggc

SEQ ID NO: 4915 - RNA, 21 nt, Homo sapiens
gaugcccaggaaagaauggca

SEQ ID NO: 4916 - RNA, 21 nt, Homo sapiens
augcccaggaaagaauggcag

SEQ ID NO: 4917 - RNA, 21 nt, Homo sapiens
ugcccaggaaagaauggcagu

SEQ ID NO: 4918 - RNA, 21 nt, Homo sapiens
gcccaggaaagaauggcaguu

SEQ ID NO: 4919 - RNA, 21 nt, Homo sapiens
cccaggaaagaauggcaguuc

SEQ ID NO: 4920 - RNA, 21 nt, Homo sapiens
ccaggaaagaauggcaguucu

SEQ ID NO: 4921 - RNA, 21 nt, Homo sapiens
caggaaagaauggcaguucuc

SEQ ID NO: 4922 - RNA, 21 nt, Homo sapiens
aggaaagaauggcaguucucc

SEQ ID NO: 4923 - RNA, 21 nt, Homo sapiens
ggaaagaauggcaguucuccg

SEQ ID NO: 4924 - RNA, 21 nt, Homo sapiens
gaaagaauggcaguucuccgc

SEQ ID NO: 4925 - RNA, 21 nt, Homo sapiens
aaagaauggcaguucuccgcg

SEQ ID NO: 4926 - RNA, 21 nt, Homo sapiens
aagaauggcaguucuccgcgg

SEQ ID NO: 4927 - RNA, 21 nt, Homo sapiens
agaauggcaguucuccgcggu

SEQ ID NO: 4928 - RNA, 21 nt, Homo sapiens
gaauggcaguucuccgcggug

SEQ ID NO: 4929 - RNA, 21 nt, Homo sapiens
aauggcaguucuccgcggugu

SEQ ID NO: 4930 - RNA, 21 nt, Homo sapiens
auggcaguucuccgcggugug

SEQ ID NO: 4931 - RNA, 21 nt, Homo sapiens
uggcaguucuccgcggugugg

SEQ ID NO: 4932 - RNA, 21 nt, Homo sapiens
ggcaguucuccgcggugugga

SEQ ID NO: 4933 - RNA, 21 nt, Homo sapiens
gcaguucuccgcgguguggag

SEQ ID NO: 4934 - RNA, 21 nt, Homo sapiens
caguucuccgcgguguggagu

SEQ ID NO: 4935 - RNA, 21 nt, Homo sapiens
aguucuccgcgguguggaguc

SEQ ID NO: 4936 - RNA, 21 nt, Homo sapiens
guucuccgcgguguggagucu

SEQ ID NO: 4937 - RNA, 21 nt, Homo sapiens
uucuccgcgguguggagucuc

SEQ ID NO: 4938 - RNA, 21 nt, Homo sapiens
ucuccgcgguguggagucucu

SEQ ID NO: 4939 - RNA, 21 nt, Homo sapiens
cuccgcgguguggagucucuc

SEQ ID NO: 4940 - RNA, 21 nt, Homo sapiens
uccgcgguguggagucucuca

SEQ ID NO: 4941 - RNA, 21 nt, Homo sapiens
ccgcgguguggagucucucac

SEQ ID NO: 4942 - RNA, 21 nt, Homo sapiens
cgcgguguggagucucucacc

SEQ ID NO: 4943 - RNA, 21 nt, Homo sapiens
gcgguguggagucucucaccg

SEQ ID NO: 4944 - RNA, 21 nt, Homo sapiens
cgguguggagucucucaccgg

SEQ ID NO: 4945 - RNA, 21 nt, Homo sapiens
gguguggagucucucaccggg

SEQ ID NO: 4946 - RNA, 21 nt, Homo sapiens
guguggagucucucaccgggc

SEQ ID NO: 4947 - RNA, 21 nt, Homo sapiens
uguggagucucucaccgggcc

SEQ ID NO: 4948 - RNA, 21 nt, Homo sapiens
guggagucucucaccgggccu

SEQ ID NO: 4949 - RNA, 21 nt, Homo sapiens
uggagucucucaccgggccua

SEQ ID NO: 4950 - RNA, 21 nt, Homo sapiens
ggagucucucaccgggccuag

SEQ ID NO: 4951 - RNA, 21 nt, Homo sapiens
gagucucucaccgggccuaga

SEQ ID NO: 4952 - RNA, 21 nt, Homo sapiens
agucucucaccgggccuagac

SEQ ID NO: 4953 - RNA, 21 nt, Homo sapiens
gucucucaccgggccuagacc

SEQ ID NO: 4954 - RNA, 21 nt, Homo sapiens
ucucucaccgggccuagaccu

SEQ ID NO: 4955 - RNA, 21 nt, Homo sapiens
cucucaccgggccuagaccua

SEQ ID NO: 4956 - RNA, 21 nt, Homo sapiens
ucucaccgggccuagaccuag

SEQ ID NO: 4957 - RNA, 21 nt, Homo sapiens
cucaccgggccuagaccuaga

SEQ ID NO: 4958 - RNA, 21 nt, Homo sapiens
ucaccgggccuagaccuagaa

SEQ ID NO: 4959 - RNA, 21 nt, Homo sapiens
caccgggccuagaccuagaag

SEQ ID NO: 4960 - RNA, 21 nt, Homo sapiens
accgggccuagaccuagaagg

SEQ ID NO: 4961 - RNA, 21 nt, Homo sapiens
ccgggccuagaccuagaaggc

SEQ ID NO: 4962 - RNA, 21 nt, Homo sapiens
cgggccuagaccuagaaggca

SEQ ID NO: 4963 - RNA, 21 nt, Homo sapiens
gggccuagaccuagaaggcag

SEQ ID NO: 4964 - RNA, 21 nt, Homo sapiens
ggccuagaccuagaaggcagg

SEQ ID NO: 4965 - RNA, 21 nt, Homo sapiens
gccuagaccuagaaggcagga

SEQ ID NO: 4966 - RNA, 21 nt, Homo sapiens
ccuagaccuagaaggcaggaa

SEQ ID NO: 4967 - RNA, 21 nt, Homo sapiens
cuagaccuagaaggcaggaau

SEQ ID NO: 4968 - RNA, 21 nt, Homo sapiens
uagaccuagaaggcaggaauc

SEQ ID NO: 4969 - RNA, 21 nt, Homo sapiens
agaccuagaaggcaggaaucc

SEQ ID NO: 4970 - RNA, 21 nt, Homo sapiens
gaccuagaaggcaggaauccc

SEQ ID NO: 4971 - RNA, 21 nt, Homo sapiens
accuagaaggcaggaauccca

SEQ ID NO: 4972 - RNA, 21 nt, Homo sapiens
ccuagaaggcaggaaucccag

SEQ ID NO: 4973 - RNA, 21 nt, Homo sapiens
cuagaaggcaggaaucccagg

SEQ ID NO: 4974 - RNA, 21 nt, Homo sapiens
uagaaggcaggaaucccaggc

SEQ ID NO: 4975 - RNA, 21 nt, Homo sapiens
agaaggcaggaaucccaggcc

SEQ ID NO: 4976 - RNA, 21 nt, Homo sapiens
gaaggcaggaaucccaggccg

SEQ ID NO: 4977 - RNA, 21 nt, Homo sapiens
aaggcaggaaucccaggccgg

SEQ ID NO: 4978 - RNA, 21 nt, Homo sapiens
aggcaggaaucccaggccggu

SEQ ID NO: 4979 - RNA, 21 nt, Homo sapiens
ggcaggaaucccaggccgguc

SEQ ID NO: 4980 - RNA, 21 nt, Homo sapiens
gcaggaaucccaggccgguca

SEQ ID NO: 4981 - RNA, 21 nt, Homo sapiens
caggaaucccaggccggucag

SEQ ID NO: 4982 - RNA, 21 nt, Homo sapiens
aggaaucccaggccggucagc

SEQ ID NO: 4983 - RNA, 21 nt, Homo sapiens
ggaaucccaggccggucagcc

SEQ ID NO: 4984 - RNA, 21 nt, Homo sapiens
gaaucccaggccggucagccc

SEQ ID NO: 4985 - RNA, 21 nt, Homo sapiens
aaucccaggccggucagcccg

SEQ ID NO: 4986 - RNA, 21 nt, Homo sapiens
aucccaggccggucagcccgg

SEQ ID NO: 4987 - RNA, 21 nt, Homo sapiens
ucccaggccggucagcccggu

SEQ ID NO: 4988 - RNA, 21 nt, Homo sapiens
cccaggccggucagcccggug

SEQ ID NO: 4989 - RNA, 21 nt, Homo sapiens
ccaggccggucagcccggugg

SEQ ID NO: 4990 - RNA, 21 nt, Homo sapiens
caggccggucagcccggugga

SEQ ID NO: 4991 - RNA, 21 nt, Homo sapiens
aggccggucagcccgguggag

SEQ ID NO: 4992 - RNA, 21 nt, Homo sapiens
ggccggucagcccgguggagg

SEQ ID NO: 4993 - RNA, 21 nt, Homo sapiens
gccggucagcccgguggaggg

SEQ ID NO: 4994 - RNA, 21 nt, Homo sapiens
ccggucagcccgguggagggg

SEQ ID NO: 4995 - RNA, 21 nt, Homo sapiens
cggucagcccgguggaggggg

SEQ ID NO: 4996 - RNA, 21 nt, Homo sapiens
ggucagcccgguggagggggc

SEQ ID NO: 4997 - RNA, 21 nt, Homo sapiens
gucagcccgguggagggggcg

SEQ ID NO: 4998 - RNA, 21 nt, Homo sapiens
ucagcccgguggagggggcgg

SEQ ID NO: 4999 - RNA, 21 nt, Homo sapiens
cagcccgguggagggggcggg

SEQ ID NO: 5000 - RNA, 21 nt, Homo sapiens
agcccgguggagggggcgggg

SEQ ID NO: 5001 - RNA, 21 nt, Homo sapiens
gcccgguggagggggcggggc

SEQ ID NO: 5002 - RNA, 21 nt, Homo sapiens
cccgguggagggggcggggcg

SEQ ID NO: 5003 - RNA, 21 nt, Homo sapiens
ccgguggagggggcggggcgg

SEQ ID NO: 5004 - RNA, 21 nt, Homo sapiens
cgguggagggggcggggcgga

SEQ ID NO: 5005 - RNA, 21 nt, Homo sapiens
gguggagggggcggggcggag

SEQ ID NO: 5006 - RNA, 21 nt, Homo sapiens
guggagggggcggggcggaga

SEQ ID NO: 5007 - RNA, 21 nt, Homo sapiens
uggagggggcggggcggagac

SEQ ID NO: 5008 - RNA, 21 nt, Homo sapiens
ggagggggcggggcggagaca

SEQ ID NO: 5009 - RNA, 21 nt, Homo sapiens
gagggggcggggcggagacac

SEQ ID NO: 5010 - RNA, 21 nt, Homo sapiens
agggggcggggcggagacacg

SEQ ID NO: 5011 - RNA, 21 nt, Homo sapiens
gggggcggggcggagacacgc

SEQ ID NO: 5012 - RNA, 21 nt, Homo sapiens
ggggcggggcggagacacgcc

SEQ ID NO: 5013 - RNA, 21 nt, Homo sapiens
gggcggggcggagacacgccc

SEQ ID NO: 5014 - RNA, 21 nt, Homo sapiens
ggcggggcggagacacgcccc

SEQ ID NO: 5015 - RNA, 21 nt, Homo sapiens
gcggggcggagacacgccccu

SEQ ID NO: 5016 - RNA, 21 nt, Homo sapiens
cggggcggagacacgccccuc

SEQ ID NO: 5017 - RNA, 21 nt, Homo sapiens
ggggcggagacacgccccucc

SEQ ID NO: 5018 - RNA, 21 nt, Homo sapiens
gggcggagacacgccccuccg

SEQ ID NO: 5019 - RNA, 21 nt, Homo sapiens
ggcggagacacgccccuccgu

SEQ ID NO: 5020 - RNA, 21 nt, Homo sapiens
gcggagacacgccccuccgua

SEQ ID NO: 5021 - RNA, 21 nt, Homo sapiens
cggagacacgccccuccguag

SEQ ID NO: 5022 - RNA, 21 nt, Homo sapiens
ggagacacgccccuccguagc

SEQ ID NO: 5023 - RNA, 21 nt, Homo sapiens
gagacacgccccuccguagcc

SEQ ID NO: 5024 - RNA, 21 nt, Homo sapiens
agacacgccccuccguagcca

SEQ ID NO: 5025 - RNA, 21 nt, Homo sapiens
gacacgccccuccguagccag

SEQ ID NO: 5026 - RNA, 21 nt, Homo sapiens
acacgccccuccguagccagc

SEQ ID NO: 5027 - RNA, 21 nt, Homo sapiens
cacgccccuccguagccagcc

SEQ ID NO: 5028 - RNA, 21 nt, Homo sapiens
acgccccuccguagccagcca

SEQ ID NO: 5029 - RNA, 21 nt, Homo sapiens
cgccccuccguagccagccag

SEQ ID NO: 5030 - RNA, 21 nt, Homo sapiens
gccccuccguagccagccagg

SEQ ID NO: 5031 - RNA, 21 nt, Homo sapiens
ccccuccguagccagccaggu

SEQ ID NO: 5032 - RNA, 21 nt, Homo sapiens
cccuccguagccagccaggug

SEQ ID NO: 5033 - RNA, 21 nt, Homo sapiens
ccuccguagccagccaggugu

SEQ ID NO: 5034 - RNA, 21 nt, Homo sapiens
cuccguagccagccagguguu

SEQ ID NO: 5035 - RNA, 21 nt, Homo sapiens
uccguagccagccagguguuc

SEQ ID NO: 5036 - RNA, 21 nt, Homo sapiens
ccguagccagccagguguucc

SEQ ID NO: 5037 - RNA, 21 nt, Homo sapiens
cguagccagccagguguuccc

SEQ ID NO: 5038 - RNA, 21 nt, Homo sapiens
guagccagccagguguucccc

SEQ ID NO: 5039 - RNA, 21 nt, Homo sapiens
uagccagccagguguuccccg

SEQ ID NO: 5040 - RNA, 21 nt, Homo sapiens
agccagccagguguuccccgc

SEQ ID NO: 5041 - RNA, 21 nt, Homo sapiens
gccagccagguguuccccgcg

SEQ ID NO: 5042 - RNA, 21 nt, Homo sapiens
ccagccagguguuccccgcga

SEQ ID NO: 5043 - RNA, 21 nt, Homo sapiens
cagccagguguuccccgcgaa

SEQ ID NO: 5044 - RNA, 21 nt, Homo sapiens
agccagguguuccccgcgaaa

SEQ ID NO: 5045 - RNA, 21 nt, Homo sapiens
gccagguguuccccgcgaaag

SEQ ID NO: 5046 - RNA, 21 nt, Homo sapiens
ccagguguuccccgcgaaaga

SEQ ID NO: 5047 - RNA, 21 nt, Homo sapiens
cagguguuccccgcgaaagag

SEQ ID NO: 5048 - RNA, 21 nt, Homo sapiens
agguguuccccgcgaaagaga

SEQ ID NO: 5049 - RNA, 21 nt, Homo sapiens
gguguuccccgcgaaagagag

SEQ ID NO: 5050 - RNA, 21 nt, Homo sapiens
guguuccccgcgaaagagagg

SEQ ID NO: 5051 - RNA, 21 nt, Homo sapiens
uguuccccgcgaaagagaggc

SEQ ID NO: 5052 - RNA, 21 nt, Homo sapiens
guuccccgcgaaagagaggcc

SEQ ID NO: 5053 - RNA, 21 nt, Homo sapiens
uuccccgcgaaagagaggcca

SEQ ID NO: 5054 - RNA, 21 nt, Homo sapiens
uccccgcgaaagagaggccac

SEQ ID NO: 5055 - RNA, 21 nt, Homo sapiens
ccccgcgaaagagaggccacg

SEQ ID NO: 5056 - RNA, 21 nt, Homo sapiens
cccgcgaaagagaggccacgg

SEQ ID NO: 5057 - RNA, 21 nt, Homo sapiens
ccgcgaaagagaggccacggc

SEQ ID NO: 5058 - RNA, 21 nt, Homo sapiens
cgcgaaagagaggccacggcc

SEQ ID NO: 5059 - RNA, 21 nt, Homo sapiens
gcgaaagagaggccacggccc

SEQ ID NO: 5060 - RNA, 21 nt, Homo sapiens
cgaaagagaggccacggcccu

SEQ ID NO: 5061 - RNA, 21 nt, Homo sapiens
gaaagagaggccacggcccug

SEQ ID NO: 5062 - RNA, 21 nt, Homo sapiens
aaagagaggccacggcccugc

SEQ ID NO: 5063 - RNA, 21 nt, Homo sapiens
aagagaggccacggcccugcc

SEQ ID NO: 5064 - RNA, 21 nt, Homo sapiens
agagaggccacggcccugccc

SEQ ID NO: 5065 - RNA, 21 nt, Homo sapiens
gagaggccacggcccugcccc

SEQ ID NO: 5066 - RNA, 21 nt, Homo sapiens
agaggccacggcccugccccg

SEQ ID NO: 5067 - RNA, 21 nt, Homo sapiens
gaggccacggcccugccccga

SEQ ID NO: 5068 - RNA, 21 nt, Homo sapiens
aggccacggcccugccccgaa

SEQ ID NO: 5069 - RNA, 21 nt, Homo sapiens
ggccacggcccugccccgaac

SEQ ID NO: 5070 - RNA, 21 nt, Homo sapiens
gccacggcccugccccgaacc

SEQ ID NO: 5071 - RNA, 21 nt, Homo sapiens
ccacggcccugccccgaacca

SEQ ID NO: 5072 - RNA, 21 nt, Homo sapiens
cacggcccugccccgaaccac

SEQ ID NO: 5073 - RNA, 21 nt, Homo sapiens
acggcccugccccgaaccacc

SEQ ID NO: 5074 - RNA, 21 nt, Homo sapiens
cggcccugccccgaaccaccc

SEQ ID NO: 5075 - RNA, 21 nt, Homo sapiens
ggcccugccccgaaccacccg

SEQ ID NO: 5076 - RNA, 21 nt, Homo sapiens
gcccugccccgaaccacccga

SEQ ID NO: 5077 - RNA, 21 nt, Homo sapiens
cccugccccgaaccacccgac

SEQ ID NO: 5078 - RNA, 21 nt, Homo sapiens
ccugccccgaaccacccgacc

SEQ ID NO: 5079 - RNA, 21 nt, Homo sapiens
cugccccgaaccacccgaccc

SEQ ID NO: 5080 - RNA, 21 nt, Homo sapiens
ugccccgaaccacccgacccc

SEQ ID NO: 5081 - RNA, 21 nt, Homo sapiens
gccccgaaccacccgaccccg

SEQ ID NO: 5082 - RNA, 21 nt, Homo sapiens
ccccgaaccacccgaccccgu

SEQ ID NO: 5083 - RNA, 21 nt, Homo sapiens
cccgaaccacccgaccccguc

SEQ ID NO: 5084 - RNA, 21 nt, Homo sapiens
ccgaaccacccgaccccgucc

SEQ ID NO: 5085 - RNA, 21 nt, Homo sapiens
cgaaccacccgaccccguccc

SEQ ID NO: 5086 - RNA, 21 nt, Homo sapiens
gaaccacccgaccccguccca

SEQ ID NO: 5087 - RNA, 21 nt, Homo sapiens
aaccacccgaccccgucccaa

SEQ ID NO: 5088 - RNA, 21 nt, Homo sapiens
accacccgaccccgucccaac

SEQ ID NO: 5089 - RNA, 21 nt, Homo sapiens
ccacccgaccccgucccaacc

SEQ ID NO: 5090 - RNA, 21 nt, Homo sapiens
cacccgaccccgucccaaccc

SEQ ID NO: 5091 - RNA, 21 nt, Homo sapiens
acccgaccccgucccaacccc

SEQ ID NO: 5092 - RNA, 21 nt, Homo sapiens
cccgaccccgucccaaccccg

SEQ ID NO: 5093 - RNA, 21 nt, Homo sapiens
ccgaccccgucccaaccccgc

SEQ ID NO: 5094 - RNA, 21 nt, Homo sapiens
cgaccccgucccaaccccgcg

SEQ ID NO: 5095 - RNA, 21 nt, Homo sapiens
gaccccgucccaaccccgcgu

SEQ ID NO: 5096 - RNA, 21 nt, Homo sapiens
accccgucccaaccccgcguc

SEQ ID NO: 5097 - RNA, 21 nt, Homo sapiens
ccccgucccaaccccgcgucc

SEQ ID NO: 5098 - RNA, 21 nt, Homo sapiens
cccgucccaaccccgcguccu

SEQ ID NO: 5099 - RNA, 21 nt, Homo sapiens
ccgucccaaccccgcguccua

SEQ ID NO: 5100 - RNA, 21 nt, Homo sapiens
cgucccaaccccgcguccuaa

SEQ ID NO: 5101 - RNA, 21 nt, Homo sapiens
gucccaaccccgcguccuaaa

SEQ ID NO: 5102 - RNA, 21 nt, Homo sapiens
ucccaaccccgcguccuaaag

SEQ ID NO: 5103 - RNA, 21 nt, Homo sapiens
cccaaccccgcguccuaaagc

SEQ ID NO: 5104 - RNA, 21 nt, Homo sapiens
ccaaccccgcguccuaaagcu

SEQ ID NO: 5105 - RNA, 21 nt, Homo sapiens
caaccccgcguccuaaagcuc

SEQ ID NO: 5106 - RNA, 21 nt, Homo sapiens
aaccccgcguccuaaagcucc

SEQ ID NO: 5107 - RNA, 21 nt, Homo sapiens
accccgcguccuaaagcuccu

SEQ ID NO: 5108 - RNA, 21 nt, Homo sapiens
ccccgcguccuaaagcuccuc

SEQ ID NO: 5109 - RNA, 21 nt, Homo sapiens
cccgcguccuaaagcuccucc

SEQ ID NO: 5110 - RNA, 21 nt, Homo sapiens
ccgcguccuaaagcuccucca

SEQ ID NO: 5111 - RNA, 21 nt, Homo sapiens
cgcguccuaaagcuccuccag

SEQ ID NO: 5112 - RNA, 21 nt, Homo sapiens
gcguccuaaagcuccuccagc

SEQ ID NO: 5113 - RNA, 21 nt, Homo sapiens
cguccuaaagcuccuccagca

SEQ ID NO: 5114 - RNA, 21 nt, Homo sapiens
guccuaaagcuccuccagcag

SEQ ID NO: 5115 - RNA, 21 nt, Homo sapiens
uccuaaagcuccuccagcaga

SEQ ID NO: 5116 - RNA, 21 nt, Homo sapiens
ccuaaagcuccuccagcagag

SEQ ID NO: 5117 - RNA, 21 nt, Homo sapiens
cuaaagcuccuccagcagagc

SEQ ID NO: 5118 - RNA, 21 nt, Homo sapiens
uaaagcuccuccagcagagcc

SEQ ID NO: 5119 - RNA, 21 nt, Homo sapiens
aaagcuccuccagcagagccc

SEQ ID NO: 5120 - RNA, 21 nt, Homo sapiens
aagcuccuccagcagagcccg

SEQ ID NO: 5121 - RNA, 21 nt, Homo sapiens
agcuccuccagcagagcccgg

SEQ ID NO: 5122 - RNA, 21 nt, Homo sapiens
gcuccuccagcagagcccggu

SEQ ID NO: 5123 - RNA, 21 nt, Homo sapiens
cuccuccagcagagcccggua

SEQ ID NO: 5124 - RNA, 21 nt, Homo sapiens
uccuccagcagagcccgguau

SEQ ID NO: 5125 - RNA, 21 nt, Homo sapiens
ccuccagcagagcccgguauu

SEQ ID NO: 5126 - RNA, 21 nt, Homo sapiens
cuccagcagagcccgguauuc

SEQ ID NO: 5127 - RNA, 21 nt, Homo sapiens
uccagcagagcccgguauucu

SEQ ID NO: 5128 - RNA, 21 nt, Homo sapiens
ccagcagagcccgguauucuu

SEQ ID NO: 5129 - RNA, 21 nt, Homo sapiens
cagcagagcccgguauucuuc

SEQ ID NO: 5130 - RNA, 21 nt, Homo sapiens
agcagagcccgguauucuucc

SEQ ID NO: 5131 - RNA, 21 nt, Homo sapiens
gcagagcccgguauucuuccu

SEQ ID NO: 5132 - RNA, 21 nt, Homo sapiens
cagagcccgguauucuuccuc

SEQ ID NO: 5133 - RNA, 21 nt, Homo sapiens
agagcccgguauucuuccucg

SEQ ID NO: 5134 - RNA, 21 nt, Homo sapiens
gagcccgguauucuuccucgc

SEQ ID NO: 5135 - RNA, 21 nt, Homo sapiens
agcccgguauucuuccucgcu

SEQ ID NO: 5136 - RNA, 21 nt, Homo sapiens
gcccgguauucuuccucgcug

SEQ ID NO: 5137 - RNA, 21 nt, Homo sapiens
cccgguauucuuccucgcuga

SEQ ID NO: 5138 - RNA, 21 nt, Homo sapiens
ccgguauucuuccucgcugag

SEQ ID NO: 5139 - RNA, 21 nt, Homo sapiens
cgguauucuuccucgcugagg

SEQ ID NO: 5140 - RNA, 21 nt, Homo sapiens
gguauucuuccucgcugaggg

SEQ ID NO: 5141 - RNA, 21 nt, Homo sapiens
guauucuuccucgcugagggg

SEQ ID NO: 5142 - RNA, 21 nt, Homo sapiens
uauucuuccucgcugaggggu

SEQ ID NO: 5143 - RNA, 21 nt, Homo sapiens
auucuuccucgcugaggggug

SEQ ID NO: 5144 - RNA, 21 nt, Homo sapiens
uucuuccucgcugaggggugc

SEQ ID NO: 5145 - RNA, 21 nt, Homo sapiens
ucuuccucgcugaggggugcu

SEQ ID NO: 5146 - RNA, 21 nt, Homo sapiens
cuuccucgcugaggggugcuu

SEQ ID NO: 5147 - RNA, 21 nt, Homo sapiens
uuccucgcugaggggugcuuc

SEQ ID NO: 5148 - RNA, 21 nt, Homo sapiens
uccucgcugaggggugcuucc

SEQ ID NO: 5149 - RNA, 21 nt, Homo sapiens
ccucgcugaggggugcuucca

SEQ ID NO: 5150 - RNA, 21 nt, Homo sapiens
cucgcugaggggugcuuccag

SEQ ID NO: 5151 - RNA, 21 nt, Homo sapiens
ucgcugaggggugcuuccagc

SEQ ID NO: 5152 - RNA, 21 nt, Homo sapiens
cgcugaggggugcuuccagcg

SEQ ID NO: 5153 - RNA, 21 nt, Homo sapiens
gcugaggggugcuuccagcga

SEQ ID NO: 5154 - RNA, 21 nt, Homo sapiens
cugaggggugcuuccagcgag

SEQ ID NO: 5155 - RNA, 21 nt, Homo sapiens
ugaggggugcuuccagcgagg

SEQ ID NO: 5156 - RNA, 21 nt, Homo sapiens
gaggggugcuuccagcgaggc

SEQ ID NO: 5157 - RNA, 21 nt, Homo sapiens
aggggugcuuccagcgaggcg

SEQ ID NO: 5158 - RNA, 21 nt, Homo sapiens
ggggugcuuccagcgaggcgg

SEQ ID NO: 5159 - RNA, 21 nt, Homo sapiens
gggugcuuccagcgaggcggc

SEQ ID NO: 5160 - RNA, 21 nt, Homo sapiens
ggugcuuccagcgaggcggcc

SEQ ID NO: 5161 - RNA, 21 nt, Homo sapiens
gugcuuccagcgaggcggccu

SEQ ID NO: 5162 - RNA, 21 nt, Homo sapiens
ugcuuccagcgaggcggccuc

SEQ ID NO: 5163 - RNA, 21 nt, Homo sapiens
gcuuccagcgaggcggccucu

SEQ ID NO: 5164 - RNA, 21 nt, Homo sapiens
cuuccagcgaggcggccucuu

SEQ ID NO: 5165 - RNA, 21 nt, Homo sapiens
uuccagcgaggcggccucuuc

SEQ ID NO: 5166 - RNA, 21 nt, Homo sapiens
uccagcgaggcggccucuucc

SEQ ID NO: 5167 - RNA, 21 nt, Homo sapiens
ccagcgaggcggccucuuccg

SEQ ID NO: 5168 - RNA, 21 nt, Homo sapiens
cagcgaggcggccucuuccga

SEQ ID NO: 5169 - RNA, 21 nt, Homo sapiens
agcgaggcggccucuuccgag

SEQ ID NO: 5170 - RNA, 21 nt, Homo sapiens
gcgaggcggccucuuccgagg

SEQ ID NO: 5171 - RNA, 21 nt, Homo sapiens
cgaggcggccucuuccgaggc

SEQ ID NO: 5172 - RNA, 21 nt, Homo sapiens
gaggcggccucuuccgaggcc

SEQ ID NO: 5173 - RNA, 21 nt, Homo sapiens
aggcggccucuuccgaggccu

SEQ ID NO: 5174 - RNA, 21 nt, Homo sapiens
ggcggccucuuccgaggccuc

SEQ ID NO: 5175 - RNA, 21 nt, Homo sapiens
gcggccucuuccgaggccucc

SEQ ID NO: 5176 - RNA, 21 nt, Homo sapiens
cggccucuuccgaggccucca

SEQ ID NO: 5177 - RNA, 21 nt, Homo sapiens
ggccucuuccgaggccuccag

SEQ ID NO: 5178 - RNA, 21 nt, Homo sapiens
gccucuuccgaggccuccagc

SEQ ID NO: 5179 - RNA, 21 nt, Homo sapiens
ccucuuccgaggccuccagcu

SEQ ID NO: 5180 - RNA, 21 nt, Homo sapiens
cucuuccgaggccuccagcuc

SEQ ID NO: 5181 - RNA, 21 nt, Homo sapiens
ucuuccgaggccuccagcucc

SEQ ID NO: 5182 - RNA, 21 nt, Homo sapiens
cuuccgaggccuccagcuccc

SEQ ID NO: 5183 - RNA, 21 nt, Homo sapiens
uuccgaggccuccagcucccc

SEQ ID NO: 5184 - RNA, 21 nt, Homo sapiens
uccgaggccuccagcuccccc

SEQ ID NO: 5185 - RNA, 21 nt, Homo sapiens
ccgaggccuccagcucccccg

SEQ ID NO: 5186 - RNA, 21 nt, Homo sapiens
cgaggccuccagcucccccgg

SEQ ID NO: 5187 - RNA, 21 nt, Homo sapiens
gaggccuccagcucccccggg

SEQ ID NO: 5188 - RNA, 21 nt, Homo sapiens
aggccuccagcucccccgggg

SEQ ID NO: 5189 - RNA, 21 nt, Homo sapiens
ggccuccagcucccccggggc

SEQ ID NO: 5190 - RNA, 21 nt, Homo sapiens
gccuccagcucccccggggcc

SEQ ID NO: 5191 - RNA, 21 nt, Homo sapiens
ccuccagcucccccggggccu

SEQ ID NO: 5192 - RNA, 21 nt, Homo sapiens
cuccagcucccccggggccuc

SEQ ID NO: 5193 - RNA, 21 nt, Homo sapiens
uccagcucccccggggccucc

SEQ ID NO: 5194 - RNA, 21 nt, Homo sapiens
ccagcucccccggggccuccg

SEQ ID NO: 5195 - RNA, 21 nt, Homo sapiens
cagcucccccggggccuccgu

SEQ ID NO: 5196 - RNA, 21 nt, Homo sapiens
agcucccccggggccuccguu

SEQ ID NO: 5197 - RNA, 21 nt, Homo sapiens
gcucccccggggccuccguuu

SEQ ID NO: 5198 - RNA, 21 nt, Homo sapiens
cucccccggggccuccguuuc

SEQ ID NO: 5199 - RNA, 21 nt, Homo sapiens
ucccccggggccuccguuucu

SEQ ID NO: 5200 - RNA, 21 nt, Homo sapiens
cccccggggccuccguuucua

SEQ ID NO: 5201 - RNA, 21 nt, Homo sapiens
ccccggggccuccguuucuag

SEQ ID NO: 5202 - RNA, 21 nt, Homo sapiens
cccggggccuccguuucuagg

SEQ ID NO: 5203 - RNA, 21 nt, Homo sapiens
ccggggccuccguuucuagga

SEQ ID NO: 5204 - RNA, 21 nt, Homo sapiens
cggggccuccguuucuaggag

SEQ ID NO: 5205 - RNA, 21 nt, Homo sapiens
ggggccuccguuucuaggaga

SEQ ID NO: 5206 - RNA, 21 nt, Homo sapiens
gggccuccguuucuaggagag

SEQ ID NO: 5207 - RNA, 21 nt, Homo sapiens
ggccuccguuucuaggagagg

SEQ ID NO: 5208 - RNA, 21 nt, Homo sapiens
gccuccguuucuaggagaggu

SEQ ID NO: 5209 - RNA, 21 nt, Homo sapiens
ccuccguuucuaggagagguu

SEQ ID NO: 5210 - RNA, 21 nt, Homo sapiens
cuccguuucuaggagagguug

SEQ ID NO: 5211 - RNA, 21 nt, Homo sapiens
uccguuucuaggagagguugc

SEQ ID NO: 5212 - RNA, 21 nt, Homo sapiens
ccguuucuaggagagguugcg

SEQ ID NO: 5213 - RNA, 21 nt, Homo sapiens
cguuucuaggagagguugcgc

SEQ ID NO: 5214 - RNA, 21 nt, Homo sapiens
guuucuaggagagguugcgcc

SEQ ID NO: 5215 - RNA, 21 nt, Homo sapiens
uuucuaggagagguugcgccu

SEQ ID NO: 5216 - RNA, 21 nt, Homo sapiens
uucuaggagagguugcgccug

SEQ ID NO: 5217 - RNA, 21 nt, Homo sapiens
ucuaggagagguugcgccugc

SEQ ID NO: 5218 - RNA, 21 nt, Homo sapiens
cuaggagagguugcgccugcu

SEQ ID NO: 5219 - RNA, 21 nt, Homo sapiens
uaggagagguugcgccugcug

SEQ ID NO: 5220 - RNA, 21 nt, Homo sapiens
aggagagguugcgccugcugc

SEQ ID NO: 5221 - RNA, 21 nt, Homo sapiens
ggagagguugcgccugcugca

SEQ ID NO: 5222 - RNA, 21 nt, Homo sapiens
gagagguugcgccugcugcag

SEQ ID NO: 5223 - RNA, 21 nt, Homo sapiens
agagguugcgccugcugcaga

SEQ ID NO: 5224 - RNA, 21 nt, Homo sapiens
gagguugcgccugcugcagaa

SEQ ID NO: 5225 - RNA, 21 nt, Homo sapiens
agguugcgccugcugcagaaa

SEQ ID NO: 5226 - RNA, 21 nt, Homo sapiens
gguugcgccugcugcagaaac

SEQ ID NO: 5227 - RNA, 21 nt, Homo sapiens
guugcgccugcugcagaaacu

SEQ ID NO: 5228 - RNA, 21 nt, Homo sapiens
uugcgccugcugcagaaacuc

SEQ ID NO: 5229 - RNA, 21 nt, Homo sapiens
ugcgccugcugcagaaacucc

SEQ ID NO: 5230 - RNA, 21 nt, Homo sapiens
gcgccugcugcagaaacuccg

SEQ ID NO: 5231 - RNA, 21 nt, Homo sapiens
cgccugcugcagaaacuccgg

SEQ ID NO: 5232 - RNA, 21 nt, Homo sapiens
gccugcugcagaaacuccggg

SEQ ID NO: 5233 - RNA, 21 nt, Homo sapiens
ccugcugcagaaacuccgggc

SEQ ID NO: 5234 - RNA, 21 nt, Homo sapiens
cugcugcagaaacuccgggcu

SEQ ID NO: 5235 - RNA, 21 nt, Homo sapiens
ugcugcagaaacuccgggcuc

SEQ ID NO: 5236 - RNA, 21 nt, Homo sapiens
gcugcagaaacuccgggcucg

SEQ ID NO: 5237 - RNA, 21 nt, Homo sapiens
cugcagaaacuccgggcucgc

SEQ ID NO: 5238 - RNA, 21 nt, Homo sapiens
ugcagaaacuccgggcucgcc

SEQ ID NO: 5239 - RNA, 21 nt, Homo sapiens
gcagaaacuccgggcucgcca

SEQ ID NO: 5240 - RNA, 21 nt, Homo sapiens
cagaaacuccgggcucgccag

SEQ ID NO: 5241 - RNA, 21 nt, Homo sapiens
agaaacuccgggcucgccagg

SEQ ID NO: 5242 - RNA, 21 nt, Homo sapiens
gaaacuccgggcucgccagga

SEQ ID NO: 5243 - RNA, 21 nt, Homo sapiens
aaacuccgggcucgccaggag

SEQ ID NO: 5244 - RNA, 21 nt, Homo sapiens
aacuccgggcucgccaggagc

SEQ ID NO: 5245 - RNA, 21 nt, Homo sapiens
acuccgggcucgccaggagcu

SEQ ID NO: 5246 - RNA, 21 nt, Homo sapiens
cuccgggcucgccaggagcuc

SEQ ID NO: 5247 - RNA, 21 nt, Homo sapiens
uccgggcucgccaggagcuca

SEQ ID NO: 5248 - RNA, 21 nt, Homo sapiens
ccgggcucgccaggagcucau

SEQ ID NO: 5249 - RNA, 21 nt, Homo sapiens
cgggcucgccaggagcucauc

SEQ ID NO: 5250 - RNA, 21 nt, Homo sapiens
gggcucgccaggagcucaucc

SEQ ID NO: 5251 - RNA, 21 nt, Homo sapiens
ggcucgccaggagcucaucca

SEQ ID NO: 5252 - RNA, 21 nt, Homo sapiens
gcucgccaggagcucauccag

SEQ ID NO: 5253 - RNA, 21 nt, Homo sapiens
cucgccaggagcucauccagc

SEQ ID NO: 5254 - RNA, 21 nt, Homo sapiens
ucgccaggagcucauccagca

SEQ ID NO: 5255 - RNA, 21 nt, Homo sapiens
cgccaggagcucauccagcag

SEQ ID NO: 5256 - RNA, 21 nt, Homo sapiens
gccaggagcucauccagcagc

SEQ ID NO: 5257 - RNA, 21 nt, Homo sapiens
ccaggagcucauccagcagca

SEQ ID NO: 5258 - RNA, 21 nt, Homo sapiens
caggagcucauccagcagcag

SEQ ID NO: 5259 - RNA, 21 nt, Homo sapiens
aggagcucauccagcagcagg

SEQ ID NO: 5260 - RNA, 21 nt, Homo sapiens
ggagcucauccagcagcaggc

SEQ ID NO: 5261 - RNA, 21 nt, Homo sapiens
gagcucauccagcagcaggcc

SEQ ID NO: 5262 - RNA, 21 nt, Homo sapiens
agcucauccagcagcaggccg

SEQ ID NO: 5263 - RNA, 21 nt, Homo sapiens
gcucauccagcagcaggccgc

SEQ ID NO: 5264 - RNA, 21 nt, Homo sapiens
cucauccagcagcaggccgca

SEQ ID NO: 5265 - RNA, 21 nt, Homo sapiens
ucauccagcagcaggccgcag

SEQ ID NO: 5266 - RNA, 21 nt, Homo sapiens
cauccagcagcaggccgcagg

SEQ ID NO: 5267 - RNA, 21 nt, Homo sapiens
auccagcagcaggccgcaggg

SEQ ID NO: 5268 - RNA, 21 nt, Homo sapiens
uccagcagcaggccgcagggg

SEQ ID NO: 5269 - RNA, 21 nt, Homo sapiens
ccagcagcaggccgcagggga

SEQ ID NO: 5270 - RNA, 21 nt, Homo sapiens
cagcagcaggccgcaggggag

SEQ ID NO: 5271 - RNA, 21 nt, Homo sapiens
agcagcaggccgcaggggagu

SEQ ID NO: 5272 - RNA, 21 nt, Homo sapiens
gcagcaggccgcaggggagug

SEQ ID NO: 5273 - RNA, 21 nt, Homo sapiens
cagcaggccgcaggggagugc

SEQ ID NO: 5274 - RNA, 21 nt, Homo sapiens
agcaggccgcaggggagugca

SEQ ID NO: 5275 - RNA, 21 nt, Homo sapiens
gcaggccgcaggggagugcag

SEQ ID NO: 5276 - RNA, 21 nt, Homo sapiens
caggccgcaggggagugcaga

SEQ ID NO: 5277 - RNA, 21 nt, Homo sapiens
aggccgcaggggagugcagac

SEQ ID NO: 5278 - RNA, 21 nt, Homo sapiens
ggccgcaggggagugcagacc

SEQ ID NO: 5279 - RNA, 21 nt, Homo sapiens
gccgcaggggagugcagacca

SEQ ID NO: 5280 - RNA, 21 nt, Homo sapiens
ccgcaggggagugcagaccag

SEQ ID NO: 5281 - RNA, 21 nt, Homo sapiens
cgcaggggagugcagaccagg

SEQ ID NO: 5282 - RNA, 21 nt, Homo sapiens
gcaggggagugcagaccaggg

SEQ ID NO: 5283 - RNA, 21 nt, Homo sapiens
caggggagugcagaccagggc

SEQ ID NO: 5284 - RNA, 21 nt, Homo sapiens
aggggagugcagaccagggcg

SEQ ID NO: 5285 - RNA, 21 nt, Homo sapiens
ggggagugcagaccagggcgc

SEQ ID NO: 5286 - RNA, 21 nt, Homo sapiens
gggagugcagaccagggcgcc

SEQ ID NO: 5287 - RNA, 21 nt, Homo sapiens
ggagugcagaccagggcgccg

SEQ ID NO: 5288 - RNA, 21 nt, Homo sapiens
gagugcagaccagggcgccgg

SEQ ID NO: 5289 - RNA, 21 nt, Homo sapiens
agugcagaccagggcgccggc

SEQ ID NO: 5290 - RNA, 21 nt, Homo sapiens
gugcagaccagggcgccggcu

SEQ ID NO: 5291 - RNA, 21 nt, Homo sapiens
ugcagaccagggcgccggcuc

SEQ ID NO: 5292 - RNA, 21 nt, Homo sapiens
gcagaccagggcgccggcucc

SEQ ID NO: 5293 - RNA, 21 nt, Homo sapiens
cagaccagggcgccggcuccu

SEQ ID NO: 5294 - RNA, 21 nt, Homo sapiens
agaccagggcgccggcuccug

SEQ ID NO: 5295 - RNA, 21 nt, Homo sapiens
gaccagggcgccggcuccugg

SEQ ID NO: 5296 - RNA, 21 nt, Homo sapiens
accagggcgccggcuccugga

SEQ ID NO: 5297 - RNA, 21 nt, Homo sapiens
ccagggcgccggcuccuggag

SEQ ID NO: 5298 - RNA, 21 nt, Homo sapiens
cagggcgccggcuccuggagc

SEQ ID NO: 5299 - RNA, 21 nt, Homo sapiens
agggcgccggcuccuggagcg

SEQ ID NO: 5300 - RNA, 21 nt, Homo sapiens
gggcgccggcuccuggagcgc

SEQ ID NO: 5301 - RNA, 21 nt, Homo sapiens
ggcgccggcuccuggagcgcc

SEQ ID NO: 5302 - RNA, 21 nt, Homo sapiens
gcgccggcuccuggagcgccu

SEQ ID NO: 5303 - RNA, 21 nt, Homo sapiens
cgccggcuccuggagcgccug

SEQ ID NO: 5304 - RNA, 21 nt, Homo sapiens
gccggcuccuggagcgccugg

SEQ ID NO: 5305 - RNA, 21 nt, Homo sapiens
ccggcuccuggagcgccuggg

SEQ ID NO: 5306 - RNA, 21 nt, Homo sapiens
cggcuccuggagcgccuggga

SEQ ID NO: 5307 - RNA, 21 nt, Homo sapiens
ggcuccuggagcgccugggag

SEQ ID NO: 5308 - RNA, 21 nt, Homo sapiens
gcuccuggagcgccugggagg

SEQ ID NO: 5309 - RNA, 21 nt, Homo sapiens
cuccuggagcgccugggaggg

SEQ ID NO: 5310 - RNA, 21 nt, Homo sapiens
uccuggagcgccugggagggc

SEQ ID NO: 5311 - RNA, 21 nt, Homo sapiens
ccuggagcgccugggagggcg

SEQ ID NO: 5312 - RNA, 21 nt, Homo sapiens
cuggagcgccugggagggcgc

SEQ ID NO: 5313 - RNA, 21 nt, Homo sapiens
uggagcgccugggagggcgcc

SEQ ID NO: 5314 - RNA, 21 nt, Homo sapiens
ggagcgccugggagggcgccg

SEQ ID NO: 5315 - RNA, 21 nt, Homo sapiens
gagcgccugggagggcgccgg

SEQ ID NO: 5316 - RNA, 21 nt, Homo sapiens
agcgccugggagggcgccggg

SEQ ID NO: 5317 - RNA, 21 nt, Homo sapiens
gcgccugggagggcgccggga

SEQ ID NO: 5318 - RNA, 21 nt, Homo sapiens
cgccugggagggcgccgggau

SEQ ID NO: 5319 - RNA, 21 nt, Homo sapiens
gccugggagggcgccgggaug

SEQ ID NO: 5320 - RNA, 21 nt, Homo sapiens
ccugggagggcgccgggaugc

SEQ ID NO: 5321 - RNA, 21 nt, Homo sapiens
cugggagggcgccgggaugcc

SEQ ID NO: 5322 - RNA, 21 nt, Homo sapiens
ugggagggcgccgggaugccu

SEQ ID NO: 5323 - RNA, 21 nt, Homo sapiens
gggagggcgccgggaugccuu

SEQ ID NO: 5324 - RNA, 21 nt, Homo sapiens
ggagggcgccgggaugccuug

SEQ ID NO: 5325 - RNA, 21 nt, Homo sapiens
gagggcgccgggaugccuugc

SEQ ID NO: 5326 - RNA, 21 nt, Homo sapiens
agggcgccgggaugccuugca

SEQ ID NO: 5327 - RNA, 21 nt, Homo sapiens
gggcgccgggaugccuugcau

SEQ ID NO: 5328 - RNA, 21 nt, Homo sapiens
ggcgccgggaugccuugcauc

SEQ ID NO: 5329 - RNA, 21 nt, Homo sapiens
gcgccgggaugccuugcaucu

SEQ ID NO: 5330 - RNA, 21 nt, Homo sapiens
cgccgggaugccuugcaucug

SEQ ID NO: 5331 - RNA, 21 nt, Homo sapiens
gccgggaugccuugcaucugc

SEQ ID NO: 5332 - RNA, 21 nt, Homo sapiens
ccgggaugccuugcaucugcc

SEQ ID NO: 5333 - RNA, 21 nt, Homo sapiens
cgggaugccuugcaucugccc

SEQ ID NO: 5334 - RNA, 21 nt, Homo sapiens
gggaugccuugcaucugcccc

SEQ ID NO: 5335 - RNA, 21 nt, Homo sapiens
ggaugccuugcaucugccccu

SEQ ID NO: 5336 - RNA, 21 nt, Homo sapiens
gaugccuugcaucugccccug

SEQ ID NO: 5337 - RNA, 21 nt, Homo sapiens
augccuugcaucugccccugc

SEQ ID NO: 5338 - RNA, 21 nt, Homo sapiens
ugccuugcaucugccccugcc

SEQ ID NO: 5339 - RNA, 21 nt, Homo sapiens
gccuugcaucugccccugccg

SEQ ID NO: 5340 - RNA, 21 nt, Homo sapiens
ccuugcaucugccccugccgc

SEQ ID NO: 5341 - RNA, 21 nt, Homo sapiens
cuugcaucugccccugccgcg

SEQ ID NO: 5342 - RNA, 21 nt, Homo sapiens
uugcaucugccccugccgcgc

SEQ ID NO: 5343 - RNA, 21 nt, Homo sapiens
ugcaucugccccugccgcgcg

SEQ ID NO: 5344 - RNA, 21 nt, Homo sapiens
gcaucugccccugccgcgcgg

SEQ ID NO: 5345 - RNA, 21 nt, Homo sapiens
caucugccccugccgcgcgga

SEQ ID NO: 5346 - RNA, 21 nt, Homo sapiens
aucugccccugccgcgcggag

SEQ ID NO: 5347 - RNA, 21 nt, Homo sapiens
ucugccccugccgcgcggagg

SEQ ID NO: 5348 - RNA, 21 nt, Homo sapiens
cugccccugccgcgcggaggc

SEQ ID NO: 5349 - RNA, 21 nt, Homo sapiens
ugccccugccgcgcggaggcg

SEQ ID NO: 5350 - RNA, 21 nt, Homo sapiens
gccccugccgcgcggaggcgg

SEQ ID NO: 5351 - RNA, 21 nt, Homo sapiens
ccccugccgcgcggaggcgga

SEQ ID NO: 5352 - RNA, 21 nt, Homo sapiens
cccugccgcgcggaggcggag

SEQ ID NO: 5353 - RNA, 21 nt, Homo sapiens
ccugccgcgcggaggcggagg

SEQ ID NO: 5354 - RNA, 21 nt, Homo sapiens
cugccgcgcggaggcggaggc

SEQ ID NO: 5355 - RNA, 21 nt, Homo sapiens
ugccgcgcggaggcggaggcg

SEQ ID NO: 5356 - RNA, 21 nt, Homo sapiens
gccgcgcggaggcggaggcgu

SEQ ID NO: 5357 - RNA, 21 nt, Homo sapiens
ccgcgcggaggcggaggcguc

SEQ ID NO: 5358 - RNA, 21 nt, Homo sapiens
cgcgcggaggcggaggcgucc

SEQ ID NO: 5359 - RNA, 21 nt, Homo sapiens
gcgcggaggcggaggcguccg

SEQ ID NO: 5360 - RNA, 21 nt, Homo sapiens
cgcggaggcggaggcguccgg

SEQ ID NO: 5361 - RNA, 21 nt, Homo sapiens
gcggaggcggaggcguccggg

SEQ ID NO: 5362 - RNA, 21 nt, Homo sapiens
cggaggcggaggcguccgggg

SEQ ID NO: 5363 - RNA, 21 nt, Homo sapiens
ggaggcggaggcguccggggg

SEQ ID NO: 5364 - RNA, 21 nt, Homo sapiens
gaggcggaggcguccgggggc

SEQ ID NO: 5365 - RNA, 21 nt, Homo sapiens
aggcggaggcguccgggggcg

SEQ ID NO: 5366 - RNA, 21 nt, Homo sapiens
ggcggaggcguccgggggcgc

SEQ ID NO: 5367 - RNA, 21 nt, Homo sapiens
gcggaggcguccgggggcgcg

SEQ ID NO: 5368 - RNA, 21 nt, Homo sapiens
cggaggcguccgggggcgcgg

SEQ ID NO: 5369 - RNA, 21 nt, Homo sapiens
ggaggcguccgggggcgcggg

SEQ ID NO: 5370 - RNA, 21 nt, Homo sapiens
gaggcguccgggggcgcgggc

SEQ ID NO: 5371 - RNA, 21 nt, Homo sapiens
aggcguccgggggcgcgggcu

SEQ ID NO: 5372 - RNA, 21 nt, Homo sapiens
ggcguccgggggcgcgggcug

SEQ ID NO: 5373 - RNA, 21 nt, Homo sapiens
gcguccgggggcgcgggcugg

SEQ ID NO: 5374 - RNA, 21 nt, Homo sapiens
cguccgggggcgcgggcuggg

SEQ ID NO: 5375 - RNA, 21 nt, Homo sapiens
guccgggggcgcgggcugggg

SEQ ID NO: 5376 - RNA, 21 nt, Homo sapiens
uccgggggcgcgggcugggga

SEQ ID NO: 5377 - RNA, 21 nt, Homo sapiens
ccgggggcgcgggcuggggag

SEQ ID NO: 5378 - RNA, 21 nt, Homo sapiens
cgggggcgcgggcuggggagg

SEQ ID NO: 5379 - RNA, 21 nt, Homo sapiens
gggggcgcgggcuggggaggu

SEQ ID NO: 5380 - RNA, 21 nt, Homo sapiens
ggggcgcgggcuggggaggug

SEQ ID NO: 5381 - RNA, 21 nt, Homo sapiens
gggcgcgggcuggggaggugg

SEQ ID NO: 5382 - RNA, 21 nt, Homo sapiens
ggcgcgggcuggggaggugga

SEQ ID NO: 5383 - RNA, 21 nt, Homo sapiens
gcgcgggcuggggagguggag

SEQ ID NO: 5384 - RNA, 21 nt, Homo sapiens
cgcgggcuggggagguggagc

SEQ ID NO: 5385 - RNA, 21 nt, Homo sapiens
gcgggcuggggagguggagcu

SEQ ID NO: 5386 - RNA, 21 nt, Homo sapiens
cgggcuggggagguggagcug

SEQ ID NO: 5387 - RNA, 21 nt, Homo sapiens
gggcuggggagguggagcugc

SEQ ID NO: 5388 - RNA, 21 nt, Homo sapiens
ggcuggggagguggagcugcc

SEQ ID NO: 5389 - RNA, 21 nt, Homo sapiens
gcuggggagguggagcugccc

SEQ ID NO: 5390 - RNA, 21 nt, Homo sapiens
cuggggagguggagcugcccc

SEQ ID NO: 5391 - RNA, 21 nt, Homo sapiens
uggggagguggagcugccccg

SEQ ID NO: 5392 - RNA, 21 nt, Homo sapiens
ggggagguggagcugccccgg

SEQ ID NO: 5393 - RNA, 21 nt, Homo sapiens
gggagguggagcugccccggc

SEQ ID NO: 5394 - RNA, 21 nt, Homo sapiens
ggagguggagcugccccggcu

SEQ ID NO: 5395 - RNA, 21 nt, Homo sapiens
gagguggagcugccccggcuu

SEQ ID NO: 5396 - RNA, 21 nt, Homo sapiens
agguggagcugccccggcuug

SEQ ID NO: 5397 - RNA, 21 nt, Homo sapiens
gguggagcugccccggcuugg

SEQ ID NO: 5398 - RNA, 21 nt, Homo sapiens
guggagcugccccggcuuggg

SEQ ID NO: 5399 - RNA, 21 nt, Homo sapiens
uggagcugccccggcuugggg

SEQ ID NO: 5400 - RNA, 21 nt, Homo sapiens
ggagcugccccggcuuggggu

SEQ ID NO: 5401 - RNA, 21 nt, Homo sapiens
gagcugccccggcuugggguu

SEQ ID NO: 5402 - RNA, 21 nt, Homo sapiens
agcugccccggcuugggguuc

SEQ ID NO: 5403 - RNA, 21 nt, Homo sapiens
gcugccccggcuugggguucc

SEQ ID NO: 5404 - RNA, 21 nt, Homo sapiens
cugccccggcuugggguuccc

SEQ ID NO: 5405 - RNA, 21 nt, Homo sapiens
ugccccggcuugggguuccca

SEQ ID NO: 5406 - RNA, 21 nt, Homo sapiens
gccccggcuugggguucccac

SEQ ID NO: 5407 - RNA, 21 nt, Homo sapiens
ccccggcuugggguucccacg

SEQ ID NO: 5408 - RNA, 21 nt, Homo sapiens
cccggcuugggguucccacgc

SEQ ID NO: 5409 - RNA, 21 nt, Homo sapiens
ccggcuugggguucccacgcc

SEQ ID NO: 5410 - RNA, 21 nt, Homo sapiens
cggcuugggguucccacgccg

SEQ ID NO: 5411 - RNA, 21 nt, Homo sapiens
ggcuugggguucccacgccgc

SEQ ID NO: 5412 - RNA, 21 nt, Homo sapiens
gcuugggguucccacgccgcc

SEQ ID NO: 5413 - RNA, 21 nt, Homo sapiens
cuugggguucccacgccgccc

SEQ ID NO: 5414 - RNA, 21 nt, Homo sapiens
uugggguucccacgccgcccc

SEQ ID NO: 5415 - RNA, 21 nt, Homo sapiens
ugggguucccacgccgccccg

SEQ ID NO: 5416 - RNA, 21 nt, Homo sapiens
gggguucccacgccgccccgg

SEQ ID NO: 5417 - RNA, 21 nt, Homo sapiens
ggguucccacgccgccccggc

SEQ ID NO: 5418 - RNA, 21 nt, Homo sapiens
gguucccacgccgccccggcg

SEQ ID NO: 5419 - RNA, 21 nt, Homo sapiens
guucccacgccgccccggcga

SEQ ID NO: 5420 - RNA, 21 nt, Homo sapiens
uucccacgccgccccggcgac

SEQ ID NO: 5421 - RNA, 21 nt, Homo sapiens
ucccacgccgccccggcgacc

SEQ ID NO: 5422 - RNA, 21 nt, Homo sapiens
cccacgccgccccggcgaccu

SEQ ID NO: 5423 - RNA, 21 nt, Homo sapiens
ccacgccgccccggcgaccug

SEQ ID NO: 5424 - RNA, 21 nt, Homo sapiens
cacgccgccccggcgaccugg

SEQ ID NO: 5425 - RNA, 21 nt, Homo sapiens
acgccgccccggcgaccuggg

SEQ ID NO: 5426 - RNA, 21 nt, Homo sapiens
cgccgccccggcgaccugggg

SEQ ID NO: 5427 - RNA, 21 nt, Homo sapiens
gccgccccggcgaccugggga

SEQ ID NO: 5428 - RNA, 21 nt, Homo sapiens
ccgccccggcgaccuggggac

SEQ ID NO: 5429 - RNA, 21 nt, Homo sapiens
cgccccggcgaccuggggacc

SEQ ID NO: 5430 - RNA, 21 nt, Homo sapiens
gccccggcgaccuggggaccc

SEQ ID NO: 5431 - RNA, 21 nt, Homo sapiens
ccccggcgaccuggggacccc

SEQ ID NO: 5432 - RNA, 21 nt, Homo sapiens
cccggcgaccuggggaccccg

SEQ ID NO: 5433 - RNA, 21 nt, Homo sapiens
ccggcgaccuggggaccccgg

SEQ ID NO: 5434 - RNA, 21 nt, Homo sapiens
cggcgaccuggggaccccggc

SEQ ID NO: 5435 - RNA, 21 nt, Homo sapiens
ggcgaccuggggaccccggcc

SEQ ID NO: 5436 - RNA, 21 nt, Homo sapiens
gcgaccuggggaccccggccc

SEQ ID NO: 5437 - RNA, 21 nt, Homo sapiens
cgaccuggggaccccggcccc

SEQ ID NO: 5438 - RNA, 21 nt, Homo sapiens
gaccuggggaccccggcccca

SEQ ID NO: 5439 - RNA, 21 nt, Homo sapiens
accuggggaccccggccccag

SEQ ID NO: 5440 - RNA, 21 nt, Homo sapiens
ccuggggaccccggccccagc

SEQ ID NO: 5441 - RNA, 21 nt, Homo sapiens
cuggggaccccggccccagcc

SEQ ID NO: 5442 - RNA, 21 nt, Homo sapiens
uggggaccccggccccagccc

SEQ ID NO: 5443 - RNA, 21 nt, Homo sapiens
ggggaccccggccccagcccc

SEQ ID NO: 5444 - RNA, 21 nt, Homo sapiens
gggaccccggccccagcccca

SEQ ID NO: 5445 - RNA, 21 nt, Homo sapiens
ggaccccggccccagccccac

SEQ ID NO: 5446 - RNA, 21 nt, Homo sapiens
gaccccggccccagccccacc

SEQ ID NO: 5447 - RNA, 21 nt, Homo sapiens
accccggccccagccccacca

SEQ ID NO: 5448 - RNA, 21 nt, Homo sapiens
ccccggccccagccccaccac

SEQ ID NO: 5449 - RNA, 21 nt, Homo sapiens
cccggccccagccccaccacg

SEQ ID NO: 5450 - RNA, 21 nt, Homo sapiens
ccggccccagccccaccacgg

SEQ ID NO: 5451 - RNA, 21 nt, Homo sapiens
cggccccagccccaccacgga

SEQ ID NO: 5452 - RNA, 21 nt, Homo sapiens
ggccccagccccaccacggac

SEQ ID NO: 5453 - RNA, 21 nt, Homo sapiens
gccccagccccaccacggacu

SEQ ID NO: 5454 - RNA, 21 nt, Homo sapiens
ccccagccccaccacggacuc

SEQ ID NO: 5455 - RNA, 21 nt, Homo sapiens
cccagccccaccacggacucc

SEQ ID NO: 5456 - RNA, 21 nt, Homo sapiens
ccagccccaccacggacuccc

SEQ ID NO: 5457 - RNA, 21 nt, Homo sapiens
cagccccaccacggacucccc

SEQ ID NO: 5458 - RNA, 21 nt, Homo sapiens
agccccaccacggacuccccu

SEQ ID NO: 5459 - RNA, 21 nt, Homo sapiens
gccccaccacggacuccccug

SEQ ID NO: 5460 - RNA, 21 nt, Homo sapiens
ccccaccacggacuccccugg

SEQ ID NO: 5461 - RNA, 21 nt, Homo sapiens
cccaccacggacuccccuggg

SEQ ID NO: 5462 - RNA, 21 nt, Homo sapiens
ccaccacggacuccccuggga

SEQ ID NO: 5463 - RNA, 21 nt, Homo sapiens
caccacggacuccccugggac

SEQ ID NO: 5464 - RNA, 21 nt, Homo sapiens
accacggacuccccugggacg

SEQ ID NO: 5465 - RNA, 21 nt, Homo sapiens
ccacggacuccccugggacgu

SEQ ID NO: 5466 - RNA, 21 nt, Homo sapiens
cacggacuccccugggacgug

SEQ ID NO: 5467 - RNA, 21 nt, Homo sapiens
acggacuccccugggacgugg

SEQ ID NO: 5468 - RNA, 21 nt, Homo sapiens
cggacuccccugggacguggg

SEQ ID NO: 5469 - RNA, 21 nt, Homo sapiens
ggacuccccugggacgugggu

SEQ ID NO: 5470 - RNA, 21 nt, Homo sapiens
gacuccccugggacgugggug

SEQ ID NO: 5471 - RNA, 21 nt, Homo sapiens
acuccccugggacgugggugg

SEQ ID NO: 5472 - RNA, 21 nt, Homo sapiens
cuccccugggacguggguggc

SEQ ID NO: 5473 - RNA, 21 nt, Homo sapiens
uccccugggacguggguggcg

SEQ ID NO: 5474 - RNA, 21 nt, Homo sapiens
ccccugggacguggguggcgc

SEQ ID NO: 5475 - RNA, 21 nt, Homo sapiens
cccugggacguggguggcgca

SEQ ID NO: 5476 - RNA, 21 nt, Homo sapiens
ccugggacguggguggcgcaa

SEQ ID NO: 5477 - RNA, 21 nt, Homo sapiens
cugggacguggguggcgcaag

SEQ ID NO: 5478 - RNA, 21 nt, Homo sapiens
ugggacguggguggcgcaagc

SEQ ID NO: 5479 - RNA, 21 nt, Homo sapiens
gggacguggguggcgcaagca

SEQ ID NO: 5480 - RNA, 21 nt, Homo sapiens
ggacguggguggcgcaagcac

SEQ ID NO: 5481 - RNA, 21 nt, Homo sapiens
gacguggguggcgcaagcacc

SEQ ID NO: 5482 - RNA, 21 nt, Homo sapiens
acguggguggcgcaagcaccc

SEQ ID NO: 5483 - RNA, 21 nt, Homo sapiens
cguggguggcgcaagcacccc

SEQ ID NO: 5484 - RNA, 21 nt, Homo sapiens
guggguggcgcaagcaccccu

SEQ ID NO: 5485 - RNA, 21 nt, Homo sapiens
uggguggcgcaagcaccccuu

SEQ ID NO: 5486 - RNA, 21 nt, Homo sapiens
ggguggcgcaagcaccccuug

SEQ ID NO: 5487 - RNA, 21 nt, Homo sapiens
gguggcgcaagcaccccuugg

SEQ ID NO: 5488 - RNA, 21 nt, Homo sapiens
guggcgcaagcaccccuuggc

SEQ ID NO: 5489 - RNA, 21 nt, Homo sapiens
uggcgcaagcaccccuuggcc

SEQ ID NO: 5490 - RNA, 21 nt, Homo sapiens
ggcgcaagcaccccuuggccc

SEQ ID NO: 5491 - RNA, 21 nt, Homo sapiens
gcgcaagcaccccuuggcccu

SEQ ID NO: 5492 - RNA, 21 nt, Homo sapiens
cgcaagcaccccuuggcccug

SEQ ID NO: 5493 - RNA, 21 nt, Homo sapiens
gcaagcaccccuuggcccugc

SEQ ID NO: 5494 - RNA, 21 nt, Homo sapiens
caagcaccccuuggcccugcg

SEQ ID NO: 5495 - RNA, 21 nt, Homo sapiens
aagcaccccuuggcccugcgg

SEQ ID NO: 5496 - RNA, 21 nt, Homo sapiens
agcaccccuuggcccugcggc

SEQ ID NO: 5497 - RNA, 21 nt, Homo sapiens
gcaccccuuggcccugcggcc

SEQ ID NO: 5498 - RNA, 21 nt, Homo sapiens
caccccuuggcccugcggccc

SEQ ID NO: 5499 - RNA, 21 nt, Homo sapiens
accccuuggcccugcggcccc

SEQ ID NO: 5500 - RNA, 21 nt, Homo sapiens
ccccuuggcccugcggccccg

SEQ ID NO: 5501 - RNA, 21 nt, Homo sapiens
cccuuggcccugcggccccgc

SEQ ID NO: 5502 - RNA, 21 nt, Homo sapiens
ccuuggcccugcggccccgcu

SEQ ID NO: 5503 - RNA, 21 nt, Homo sapiens
cuuggcccugcggccccgcuu

SEQ ID NO: 5504 - RNA, 21 nt, Homo sapiens
uuggcccugcggccccgcuug

SEQ ID NO: 5505 - RNA, 21 nt, Homo sapiens
uggcccugcggccccgcuuga

SEQ ID NO: 5506 - RNA, 21 nt, Homo sapiens
ggcccugcggccccgcuugag

SEQ ID NO: 5507 - RNA, 21 nt, Homo sapiens
gcccugcggccccgcuugagc

SEQ ID NO: 5508 - RNA, 21 nt, Homo sapiens
cccugcggccccgcuugagcg

SEQ ID NO: 5509 - RNA, 21 nt, Homo sapiens
ccugcggccccgcuugagcgg

SEQ ID NO: 5510 - RNA, 21 nt, Homo sapiens
cugcggccccgcuugagcggg

SEQ ID NO: 5511 - RNA, 21 nt, Homo sapiens
ugcggccccgcuugagcgggc

SEQ ID NO: 5512 - RNA, 21 nt, Homo sapiens
gcggccccgcuugagcgggcc

SEQ ID NO: 5513 - RNA, 21 nt, Homo sapiens
cggccccgcuugagcgggccc

SEQ ID NO: 5514 - RNA, 21 nt, Homo sapiens
ggccccgcuugagcgggccca

SEQ ID NO: 5515 - RNA, 21 nt, Homo sapiens
gccccgcuugagcgggcccag

SEQ ID NO: 5516 - RNA, 21 nt, Homo sapiens
ccccgcuugagcgggcccagg

SEQ ID NO: 5517 - RNA, 21 nt, Homo sapiens
cccgcuugagcgggcccaggc

SEQ ID NO: 5518 - RNA, 21 nt, Homo sapiens
ccgcuugagcgggcccaggcu

SEQ ID NO: 5519 - RNA, 21 nt, Homo sapiens
cgcuugagcgggcccaggcug

SEQ ID NO: 5520 - RNA, 21 nt, Homo sapiens
gcuugagcgggcccaggcugu

SEQ ID NO: 5521 - RNA, 21 nt, Homo sapiens
cuugagcgggcccaggcugug

SEQ ID NO: 5522 - RNA, 21 nt, Homo sapiens
uugagcgggcccaggcugugc

SEQ ID NO: 5523 - RNA, 21 nt, Homo sapiens
ugagcgggcccaggcugugcc

SEQ ID NO: 5524 - RNA, 21 nt, Homo sapiens
gagcgggcccaggcugugcca

SEQ ID NO: 5525 - RNA, 21 nt, Homo sapiens
agcgggcccaggcugugccac

SEQ ID NO: 5526 - RNA, 21 nt, Homo sapiens
gcgggcccaggcugugccacc

SEQ ID NO: 5527 - RNA, 21 nt, Homo sapiens
cgggcccaggcugugccaccg

SEQ ID NO: 5528 - RNA, 21 nt, Homo sapiens
gggcccaggcugugccaccgc

SEQ ID NO: 5529 - RNA, 21 nt, Homo sapiens
ggcccaggcugugccaccgcg

SEQ ID NO: 5530 - RNA, 21 nt, Homo sapiens
gcccaggcugugccaccgcgc

SEQ ID NO: 5531 - RNA, 21 nt, Homo sapiens
cccaggcugugccaccgcgca

SEQ ID NO: 5532 - RNA, 21 nt, Homo sapiens
ccaggcugugccaccgcgcag

SEQ ID NO: 5533 - RNA, 21 nt, Homo sapiens
caggcugugccaccgcgcagg

SEQ ID NO: 5534 - RNA, 21 nt, Homo sapiens
aggcugugccaccgcgcaggg

SEQ ID NO: 5535 - RNA, 21 nt, Homo sapiens
ggcugugccaccgcgcagggg

SEQ ID NO: 5536 - RNA, 21 nt, Homo sapiens
gcugugccaccgcgcaggggc

SEQ ID NO: 5537 - RNA, 21 nt, Homo sapiens
cugugccaccgcgcaggggcc

SEQ ID NO: 5538 - RNA, 21 nt, Homo sapiens
ugugccaccgcgcaggggccc

SEQ ID NO: 5539 - RNA, 21 nt, Homo sapiens
gugccaccgcgcaggggcccg

SEQ ID NO: 5540 - RNA, 21 nt, Homo sapiens
ugccaccgcgcaggggcccgg

SEQ ID NO: 5541 - RNA, 21 nt, Homo sapiens
gccaccgcgcaggggcccggc

SEQ ID NO: 5542 - RNA, 21 nt, Homo sapiens
ccaccgcgcaggggcccggca

SEQ ID NO: 5543 - RNA, 21 nt, Homo sapiens
caccgcgcaggggcccggcag

SEQ ID NO: 5544 - RNA, 21 nt, Homo sapiens
accgcgcaggggcccggcagg

SEQ ID NO: 5545 - RNA, 21 nt, Homo sapiens
ccgcgcaggggcccggcaggc

SEQ ID NO: 5546 - RNA, 21 nt, Homo sapiens
cgcgcaggggcccggcaggcc

SEQ ID NO: 5547 - RNA, 21 nt, Homo sapiens
gcgcaggggcccggcaggccg

SEQ ID NO: 5548 - RNA, 21 nt, Homo sapiens
cgcaggggcccggcaggccgu

SEQ ID NO: 5549 - RNA, 21 nt, Homo sapiens
gcaggggcccggcaggccguc

SEQ ID NO: 5550 - RNA, 21 nt, Homo sapiens
caggggcccggcaggccgucg

SEQ ID NO: 5551 - RNA, 21 nt, Homo sapiens
aggggcccggcaggccgucgc

SEQ ID NO: 5552 - RNA, 21 nt, Homo sapiens
ggggcccggcaggccgucgcg

SEQ ID NO: 5553 - RNA, 21 nt, Homo sapiens
gggcccggcaggccgucgcgc

SEQ ID NO: 5554 - RNA, 21 nt, Homo sapiens
ggcccggcaggccgucgcgcu

SEQ ID NO: 5555 - RNA, 21 nt, Homo sapiens
gcccggcaggccgucgcgcug

SEQ ID NO: 5556 - RNA, 21 nt, Homo sapiens
cccggcaggccgucgcgcugc

SEQ ID NO: 5557 - RNA, 21 nt, Homo sapiens
ccggcaggccgucgcgcugcg

SEQ ID NO: 5558 - RNA, 21 nt, Homo sapiens
cggcaggccgucgcgcugcgg

SEQ ID NO: 5559 - RNA, 21 nt, Homo sapiens
ggcaggccgucgcgcugcggg

SEQ ID NO: 5560 - RNA, 21 nt, Homo sapiens
gcaggccgucgcgcugcgggu

SEQ ID NO: 5561 - RNA, 21 nt, Homo sapiens
caggccgucgcgcugcggguc

SEQ ID NO: 5562 - RNA, 21 nt, Homo sapiens
aggccgucgcgcugcgggucc

SEQ ID NO: 5563 - RNA, 21 nt, Homo sapiens
ggccgucgcgcugcggguccc

SEQ ID NO: 5564 - RNA, 21 nt, Homo sapiens
gccgucgcgcugcgggucccg

SEQ ID NO: 5565 - RNA, 21 nt, Homo sapiens
ccgucgcgcugcgggucccgg

SEQ ID NO: 5566 - RNA, 21 nt, Homo sapiens
cgucgcgcugcgggucccggu

SEQ ID NO: 5567 - RNA, 21 nt, Homo sapiens
gucgcgcugcgggucccgguc

SEQ ID NO: 5568 - RNA, 21 nt, Homo sapiens
ucgcgcugcgggucccggucc

SEQ ID NO: 5569 - RNA, 21 nt, Homo sapiens
cgcgcugcgggucccgguccu

SEQ ID NO: 5570 - RNA, 21 nt, Homo sapiens
gcgcugcgggucccgguccuc

SEQ ID NO: 5571 - RNA, 21 nt, Homo sapiens
cgcugcgggucccgguccucc

SEQ ID NO: 5572 - RNA, 21 nt, Homo sapiens
gcugcgggucccgguccuccc

SEQ ID NO: 5573 - RNA, 21 nt, Homo sapiens
cugcgggucccgguccucccg

SEQ ID NO: 5574 - RNA, 21 nt, Homo sapiens
ugcgggucccgguccucccgg

SEQ ID NO: 5575 - RNA, 21 nt, Homo sapiens
gcgggucccgguccucccggc

SEQ ID NO: 5576 - RNA, 21 nt, Homo sapiens
cgggucccgguccucccggcu

SEQ ID NO: 5577 - RNA, 21 nt, Homo sapiens
gggucccgguccucccggcuu

SEQ ID NO: 5578 - RNA, 21 nt, Homo sapiens
ggucccgguccucccggcuuu

SEQ ID NO: 5579 - RNA, 21 nt, Homo sapiens
gucccgguccucccggcuuuu

SEQ ID NO: 5580 - RNA, 21 nt, Homo sapiens
ucccgguccucccggcuuuug

SEQ ID NO: 5581 - RNA, 21 nt, Homo sapiens
cccgguccucccggcuuuugc

SEQ ID NO: 5582 - RNA, 21 nt, Homo sapiens
ccgguccucccggcuuuugcc

SEQ ID NO: 5583 - RNA, 21 nt, Homo sapiens
cgguccucccggcuuuugccc

SEQ ID NO: 5584 - RNA, 21 nt, Homo sapiens
gguccucccggcuuuugcccg

SEQ ID NO: 5585 - RNA, 21 nt, Homo sapiens
guccucccggcuuuugcccgg

SEQ ID NO: 5586 - RNA, 21 nt, Homo sapiens
uccucccggcuuuugcccggg

SEQ ID NO: 5587 - RNA, 21 nt, Homo sapiens
ccucccggcuuuugcccgggu

SEQ ID NO: 5588 - RNA, 21 nt, Homo sapiens
cucccggcuuuugcccgggug

SEQ ID NO: 5589 - RNA, 21 nt, Homo sapiens
ucccggcuuuugcccgggugc

SEQ ID NO: 5590 - RNA, 21 nt, Homo sapiens
cccggcuuuugcccgggugcg

SEQ ID NO: 5591 - RNA, 21 nt, Homo sapiens
ccggcuuuugcccgggugcgg

SEQ ID NO: 5592 - RNA, 21 nt, Homo sapiens
cggcuuuugcccgggugcgga

SEQ ID NO: 5593 - RNA, 21 nt, Homo sapiens
ggcuuuugcccgggugcggag

SEQ ID NO: 5594 - RNA, 21 nt, Homo sapiens
gcuuuugcccgggugcggagg

SEQ ID NO: 5595 - RNA, 21 nt, Homo sapiens
cuuuugcccgggugcggaggc

SEQ ID NO: 5596 - RNA, 21 nt, Homo sapiens
uuuugcccgggugcggaggcc

SEQ ID NO: 5597 - RNA, 21 nt, Homo sapiens
uuugcccgggugcggaggcca

SEQ ID NO: 5598 - RNA, 21 nt, Homo sapiens
uugcccgggugcggaggccag

SEQ ID NO: 5599 - RNA, 21 nt, Homo sapiens
ugcccgggugcggaggccagc

SEQ ID NO: 5600 - RNA, 21 nt, Homo sapiens
gcccgggugcggaggccagcg

SEQ ID NO: 5601 - RNA, 21 nt, Homo sapiens
cccgggugcggaggccagcga

SEQ ID NO: 5602 - RNA, 21 nt, Homo sapiens
ccgggugcggaggccagcgag

SEQ ID NO: 5603 - RNA, 21 nt, Homo sapiens
cgggugcggaggccagcgagg

SEQ ID NO: 5604 - RNA, 21 nt, Homo sapiens
gggugcggaggccagcgagga

SEQ ID NO: 5605 - RNA, 21 nt, Homo sapiens
ggugcggaggccagcgaggag

SEQ ID NO: 5606 - RNA, 21 nt, Homo sapiens
gugcggaggccagcgaggagc

SEQ ID NO: 5607 - RNA, 21 nt, Homo sapiens
ugcggaggccagcgaggagcc

SEQ ID NO: 5608 - RNA, 21 nt, Homo sapiens
gcggaggccagcgaggagccu

SEQ ID NO: 5609 - RNA, 21 nt, Homo sapiens
cggaggccagcgaggagccug

SEQ ID NO: 5610 - RNA, 21 nt, Homo sapiens
ggaggccagcgaggagccuga

SEQ ID NO: 5611 - RNA, 21 nt, Homo sapiens
gaggccagcgaggagccugag

SEQ ID NO: 5612 - RNA, 21 nt, Homo sapiens
aggccagcgaggagccugagg

SEQ ID NO: 5613 - RNA, 21 nt, Homo sapiens
ggccagcgaggagccugaggg

SEQ ID NO: 5614 - RNA, 21 nt, Homo sapiens
gccagcgaggagccugagggu

SEQ ID NO: 5615 - RNA, 21 nt, Homo sapiens
ccagcgaggagccugagggug

SEQ ID NO: 5616 - RNA, 21 nt, Homo sapiens
cagcgaggagccugagggugg

SEQ ID NO: 5617 - RNA, 21 nt, Homo sapiens
agcgaggagccugaggguggg

SEQ ID NO: 5618 - RNA, 21 nt, Homo sapiens
gcgaggagccugaggguggga

SEQ ID NO: 5619 - RNA, 21 nt, Homo sapiens
cgaggagccugagggugggag

SEQ ID NO: 5620 - RNA, 21 nt, Homo sapiens
gaggagccugagggugggaga

SEQ ID NO: 5621 - RNA, 21 nt, Homo sapiens
aggagccugagggugggagag

SEQ ID NO: 5622 - RNA, 21 nt, Homo sapiens
ggagccugagggugggagagc

SEQ ID NO: 5623 - RNA, 21 nt, Homo sapiens
gagccugagggugggagagcg

SEQ ID NO: 5624 - RNA, 21 nt, Homo sapiens
agccugagggugggagagcgc

SEQ ID NO: 5625 - RNA, 21 nt, Homo sapiens
gccugagggugggagagcgcc

SEQ ID NO: 5626 - RNA, 21 nt, Homo sapiens
ccugagggugggagagcgccc

SEQ ID NO: 5627 - RNA, 21 nt, Homo sapiens
cugagggugggagagcgcccc

SEQ ID NO: 5628 - RNA, 21 nt, Homo sapiens
ugagggugggagagcgccccg

SEQ ID NO: 5629 - RNA, 21 nt, Homo sapiens
gagggugggagagcgccccgu

SEQ ID NO: 5630 - RNA, 21 nt, Homo sapiens
agggugggagagcgccccguc

SEQ ID NO: 5631 - RNA, 21 nt, Homo sapiens
gggugggagagcgccccgucc

SEQ ID NO: 5632 - RNA, 21 nt, Homo sapiens
ggugggagagcgccccguccg

SEQ ID NO: 5633 - RNA, 21 nt, Homo sapiens
gugggagagcgccccguccgg

SEQ ID NO: 5634 - RNA, 21 nt, Homo sapiens
ugggagagcgccccguccgga

SEQ ID NO: 5635 - RNA, 21 nt, Homo sapiens
gggagagcgccccguccggag

SEQ ID NO: 5636 - RNA, 21 nt, Homo sapiens
ggagagcgccccguccggagg

SEQ ID NO: 5637 - RNA, 21 nt, Homo sapiens
gagagcgccccguccggagga

SEQ ID NO: 5638 - RNA, 21 nt, Homo sapiens
agagcgccccguccggaggag

SEQ ID NO: 5639 - RNA, 21 nt, Homo sapiens
gagcgccccguccggaggagc

SEQ ID NO: 5640 - RNA, 21 nt, Homo sapiens
agcgccccguccggaggagcc

SEQ ID NO: 5641 - RNA, 21 nt, Homo sapiens
gcgccccguccggaggagccg

SEQ ID NO: 5642 - RNA, 21 nt, Homo sapiens
cgccccguccggaggagccgg

SEQ ID NO: 5643 - RNA, 21 nt, Homo sapiens
gccccguccggaggagccggg

SEQ ID NO: 5644 - RNA, 21 nt, Homo sapiens
ccccguccggaggagccgggg

SEQ ID NO: 5645 - RNA, 21 nt, Homo sapiens
cccguccggaggagccggggc

SEQ ID NO: 5646 - RNA, 21 nt, Homo sapiens
ccguccggaggagccggggcg

SEQ ID NO: 5647 - RNA, 21 nt, Homo sapiens
cguccggaggagccggggcgg

SEQ ID NO: 5648 - RNA, 21 nt, Homo sapiens
guccggaggagccggggcggc

SEQ ID NO: 5649 - RNA, 21 nt, Homo sapiens
uccggaggagccggggcggcg

SEQ ID NO: 5650 - RNA, 21 nt, Homo sapiens
ccggaggagccggggcggcgu

SEQ ID NO: 5651 - RNA, 21 nt, Homo sapiens
cggaggagccggggcggcgua

SEQ ID NO: 5652 - RNA, 21 nt, Homo sapiens
ggaggagccggggcggcguag

SEQ ID NO: 5653 - RNA, 21 nt, Homo sapiens
gaggagccggggcggcguagg

SEQ ID NO: 5654 - RNA, 21 nt, Homo sapiens
aggagccggggcggcguaggc

SEQ ID NO: 5655 - RNA, 21 nt, Homo sapiens
ggagccggggcggcguaggcg

SEQ ID NO: 5656 - RNA, 21 nt, Homo sapiens
gagccggggcggcguaggcga

SEQ ID NO: 5657 - RNA, 21 nt, Homo sapiens
agccggggcggcguaggcgaa

SEQ ID NO: 5658 - RNA, 21 nt, Homo sapiens
gccggggcggcguaggcgaaa

SEQ ID NO: 5659 - RNA, 21 nt, Homo sapiens
ccggggcggcguaggcgaaau

SEQ ID NO: 5660 - RNA, 21 nt, Homo sapiens
cggggcggcguaggcgaaauc

SEQ ID NO: 5661 - RNA, 21 nt, Homo sapiens
ggggcggcguaggcgaaaucc

SEQ ID NO: 5662 - RNA, 21 nt, Homo sapiens
gggcggcguaggcgaaauccc

SEQ ID NO: 5663 - RNA, 21 nt, Homo sapiens
ggcggcguaggcgaaaucccc

SEQ ID NO: 5664 - RNA, 21 nt, Homo sapiens
gcggcguaggcgaaauccccg

SEQ ID NO: 5665 - RNA, 21 nt, Homo sapiens
cggcguaggcgaaauccccgc

SEQ ID NO: 5666 - RNA, 21 nt, Homo sapiens
ggcguaggcgaaauccccgcg

SEQ ID NO: 5667 - RNA, 21 nt, Homo sapiens
gcguaggcgaaauccccgcgc

SEQ ID NO: 5668 - RNA, 21 nt, Homo sapiens
cguaggcgaaauccccgcgcg

SEQ ID NO: 5669 - RNA, 21 nt, Homo sapiens
guaggcgaaauccccgcgcgc

SEQ ID NO: 5670 - RNA, 21 nt, Homo sapiens
uaggcgaaauccccgcgcgcc

SEQ ID NO: 5671 - RNA, 21 nt, Homo sapiens
aggcgaaauccccgcgcgccg

SEQ ID NO: 5672 - RNA, 21 nt, Homo sapiens
ggcgaaauccccgcgcgccgg

SEQ ID NO: 5673 - RNA, 21 nt, Homo sapiens
gcgaaauccccgcgcgccggg

SEQ ID NO: 5674 - RNA, 21 nt, Homo sapiens
cgaaauccccgcgcgccgggg

SEQ ID NO: 5675 - RNA, 21 nt, Homo sapiens
gaaauccccgcgcgccggggc

SEQ ID NO: 5676 - RNA, 21 nt, Homo sapiens
aaauccccgcgcgccggggca

SEQ ID NO: 5677 - RNA, 21 nt, Homo sapiens
aauccccgcgcgccggggcag

SEQ ID NO: 5678 - RNA, 21 nt, Homo sapiens
auccccgcgcgccggggcagg

SEQ ID NO: 5679 - RNA, 21 nt, Homo sapiens
uccccgcgcgccggggcaggu

SEQ ID NO: 5680 - RNA, 21 nt, Homo sapiens
ccccgcgcgccggggcagguu

SEQ ID NO: 5681 - RNA, 21 nt, Homo sapiens
cccgcgcgccggggcagguug

SEQ ID NO: 5682 - RNA, 21 nt, Homo sapiens
ccgcgcgccggggcagguugg

SEQ ID NO: 5683 - RNA, 21 nt, Homo sapiens
cgcgcgccggggcagguuggg

SEQ ID NO: 5684 - RNA, 21 nt, Homo sapiens
gcgcgccggggcagguuggga

SEQ ID NO: 5685 - RNA, 21 nt, Homo sapiens
cgcgccggggcagguugggag

SEQ ID NO: 5686 - RNA, 21 nt, Homo sapiens
gcgccggggcagguugggaga

SEQ ID NO: 5687 - RNA, 21 nt, Homo sapiens
cgccggggcagguugggagau

SEQ ID NO: 5688 - RNA, 21 nt, Homo sapiens
gccggggcagguugggagauc

SEQ ID NO: 5689 - RNA, 21 nt, Homo sapiens
ccggggcagguugggagaucc

SEQ ID NO: 5690 - RNA, 21 nt, Homo sapiens
cggggcagguugggagauccc

SEQ ID NO: 5691 - RNA, 21 nt, Homo sapiens
ggggcagguugggagaucccc

SEQ ID NO: 5692 - RNA, 21 nt, Homo sapiens
gggcagguugggagauccccu

SEQ ID NO: 5693 - RNA, 21 nt, Homo sapiens
ggcagguugggagauccccuc

SEQ ID NO: 5694 - RNA, 21 nt, Homo sapiens
gcagguugggagauccccucu

SEQ ID NO: 5695 - RNA, 21 nt, Homo sapiens
cagguugggagauccccucug

SEQ ID NO: 5696 - RNA, 21 nt, Homo sapiens
agguugggagauccccucugc

SEQ ID NO: 5697 - RNA, 21 nt, Homo sapiens
gguugggagauccccucugcc

SEQ ID NO: 5698 - RNA, 21 nt, Homo sapiens
guugggagauccccucugccg

SEQ ID NO: 5699 - RNA, 21 nt, Homo sapiens
uugggagauccccucugccgg

SEQ ID NO: 5700 - RNA, 21 nt, Homo sapiens
ugggagauccccucugccggc

SEQ ID NO: 5701 - RNA, 21 nt, Homo sapiens
gggagauccccucugccggcg

SEQ ID NO: 5702 - RNA, 21 nt, Homo sapiens
ggagauccccucugccggcgc

SEQ ID NO: 5703 - RNA, 21 nt, Homo sapiens
gagauccccucugccggcgcg

SEQ ID NO: 5704 - RNA, 21 nt, Homo sapiens
agauccccucugccggcgcgg

SEQ ID NO: 5705 - RNA, 21 nt, Homo sapiens
gauccccucugccggcgcggc

SEQ ID NO: 5706 - RNA, 21 nt, Homo sapiens
auccccucugccggcgcggcc

SEQ ID NO: 5707 - RNA, 21 nt, Homo sapiens
uccccucugccggcgcggccu

SEQ ID NO: 5708 - RNA, 21 nt, Homo sapiens
ccccucugccggcgcggccug

SEQ ID NO: 5709 - RNA, 21 nt, Homo sapiens
cccucugccggcgcggccugg

SEQ ID NO: 5710 - RNA, 21 nt, Homo sapiens
ccucugccggcgcggccuggc

SEQ ID NO: 5711 - RNA, 21 nt, Homo sapiens
cucugccggcgcggccuggcu

SEQ ID NO: 5712 - RNA, 21 nt, Homo sapiens
ucugccggcgcggccuggcug

SEQ ID NO: 5713 - RNA, 21 nt, Homo sapiens
cugccggcgcggccuggcugg

SEQ ID NO: 5714 - RNA, 21 nt, Homo sapiens
ugccggcgcggccuggcuggg

SEQ ID NO: 5715 - RNA, 21 nt, Homo sapiens
gccggcgcggccuggcugggc

SEQ ID NO: 5716 - RNA, 21 nt, Homo sapiens
ccggcgcggccuggcugggcu

SEQ ID NO: 5717 - RNA, 21 nt, Homo sapiens
cggcgcggccuggcugggcug

SEQ ID NO: 5718 - RNA, 21 nt, Homo sapiens
ggcgcggccuggcugggcugc

SEQ ID NO: 5719 - RNA, 21 nt, Homo sapiens
gcgcggccuggcugggcugca

SEQ ID NO: 5720 - RNA, 21 nt, Homo sapiens
cgcggccuggcugggcugcag

SEQ ID NO: 5721 - RNA, 21 nt, Homo sapiens
gcggccuggcugggcugcagc

SEQ ID NO: 5722 - RNA, 21 nt, Homo sapiens
cggccuggcugggcugcagcg

SEQ ID NO: 5723 - RNA, 21 nt, Homo sapiens
ggccuggcugggcugcagcgc

SEQ ID NO: 5724 - RNA, 21 nt, Homo sapiens
gccuggcugggcugcagcgcg

SEQ ID NO: 5725 - RNA, 21 nt, Homo sapiens
ccuggcugggcugcagcgcgg

SEQ ID NO: 5726 - RNA, 21 nt, Homo sapiens
cuggcugggcugcagcgcggg

SEQ ID NO: 5727 - RNA, 21 nt, Homo sapiens
uggcugggcugcagcgcgggg

SEQ ID NO: 5728 - RNA, 21 nt, Homo sapiens
ggcugggcugcagcgcggggg

SEQ ID NO: 5729 - RNA, 21 nt, Homo sapiens
gcugggcugcagcgcgggggc

SEQ ID NO: 5730 - RNA, 21 nt, Homo sapiens
cugggcugcagcgcgggggcg

SEQ ID NO: 5731 - RNA, 21 nt, Homo sapiens
ugggcugcagcgcgggggcgg

SEQ ID NO: 5732 - RNA, 21 nt, Homo sapiens
gggcugcagcgcgggggcggc

SEQ ID NO: 5733 - RNA, 21 nt, Homo sapiens
ggcugcagcgcgggggcggcc

SEQ ID NO: 5734 - RNA, 21 nt, Homo sapiens
gcugcagcgcgggggcggccc

SEQ ID NO: 5735 - RNA, 21 nt, Homo sapiens
cugcagcgcgggggcggcccu

SEQ ID NO: 5736 - RNA, 21 nt, Homo sapiens
ugcagcgcgggggcggcccuc

SEQ ID NO: 5737 - RNA, 21 nt, Homo sapiens
gcagcgcgggggcggcccucg

SEQ ID NO: 5738 - RNA, 21 nt, Homo sapiens
cagcgcgggggcggcccucgc

SEQ ID NO: 5739 - RNA, 21 nt, Homo sapiens
agcgcgggggcggcccucgcu

SEQ ID NO: 5740 - RNA, 21 nt, Homo sapiens
gcgcgggggcggcccucgcug

SEQ ID NO: 5741 - RNA, 21 nt, Homo sapiens
cgcgggggcggcccucgcugc

SEQ ID NO: 5742 - RNA, 21 nt, Homo sapiens
gcgggggcggcccucgcugcc

SEQ ID NO: 5743 - RNA, 21 nt, Homo sapiens
cgggggcggcccucgcugccu

SEQ ID NO: 5744 - RNA, 21 nt, Homo sapiens
gggggcggcccucgcugccug

SEQ ID NO: 5745 - RNA, 21 nt, Homo sapiens
ggggcggcccucgcugccugg

SEQ ID NO: 5746 - RNA, 21 nt, Homo sapiens
gggcggcccucgcugccuggc

SEQ ID NO: 5747 - RNA, 21 nt, Homo sapiens
ggcggcccucgcugccuggcu

SEQ ID NO: 5748 - RNA, 21 nt, Homo sapiens
gcggcccucgcugccuggcuc

SEQ ID NO: 5749 - RNA, 21 nt, Homo sapiens
cggcccucgcugccuggcuca

SEQ ID NO: 5750 - RNA, 21 nt, Homo sapiens
ggcccucgcugccuggcucac

SEQ ID NO: 5751 - RNA, 21 nt, Homo sapiens
gcccucgcugccuggcucacg

SEQ ID NO: 5752 - RNA, 21 nt, Homo sapiens
cccucgcugccuggcucacga

SEQ ID NO: 5753 - RNA, 21 nt, Homo sapiens
ccucgcugccuggcucacgaa

SEQ ID NO: 5754 - RNA, 21 nt, Homo sapiens
cucgcugccuggcucacgaaa

SEQ ID NO: 5755 - RNA, 21 nt, Homo sapiens
ucgcugccuggcucacgaaag

SEQ ID NO: 5756 - RNA, 21 nt, Homo sapiens
cgcugccuggcucacgaaagc

SEQ ID NO: 5757 - RNA, 21 nt, Homo sapiens
gcugccuggcucacgaaagcc

SEQ ID NO: 5758 - RNA, 21 nt, Homo sapiens
cugccuggcucacgaaagccc

SEQ ID NO: 5759 - RNA, 21 nt, Homo sapiens
ugccuggcucacgaaagcccc

SEQ ID NO: 5760 - RNA, 21 nt, Homo sapiens
gccuggcucacgaaagccccc

SEQ ID NO: 5761 - RNA, 21 nt, Homo sapiens
ccuggcucacgaaagcccccu

SEQ ID NO: 5762 - RNA, 21 nt, Homo sapiens
cuggcucacgaaagcccccug

SEQ ID NO: 5763 - RNA, 21 nt, Homo sapiens
uggcucacgaaagcccccugu

SEQ ID NO: 5764 - RNA, 21 nt, Homo sapiens
ggcucacgaaagcccccugug

SEQ ID NO: 5765 - RNA, 21 nt, Homo sapiens
gcucacgaaagcccccugugg

SEQ ID NO: 5766 - RNA, 21 nt, Homo sapiens
cucacgaaagcccccuguggg

SEQ ID NO: 5767 - RNA, 21 nt, Homo sapiens
ucacgaaagcccccuguggga

SEQ ID NO: 5768 - RNA, 21 nt, Homo sapiens
cacgaaagcccccugugggag

SEQ ID NO: 5769 - RNA, 21 nt, Homo sapiens
acgaaagcccccugugggaga

SEQ ID NO: 5770 - RNA, 21 nt, Homo sapiens
cgaaagcccccugugggagag

SEQ ID NO: 5771 - RNA, 21 nt, Homo sapiens
gaaagcccccugugggagagc

SEQ ID NO: 5772 - RNA, 21 nt, Homo sapiens
aaagcccccugugggagagcc

SEQ ID NO: 5773 - RNA, 21 nt, Homo sapiens
aagcccccugugggagagccc

SEQ ID NO: 5774 - RNA, 21 nt, Homo sapiens
agcccccugugggagagcccc

SEQ ID NO: 5775 - RNA, 21 nt, Homo sapiens
gcccccugugggagagcccca

SEQ ID NO: 5776 - RNA, 21 nt, Homo sapiens
cccccugugggagagccccag

SEQ ID NO: 5777 - RNA, 21 nt, Homo sapiens
ccccugugggagagccccagg

SEQ ID NO: 5778 - RNA, 21 nt, Homo sapiens
cccugugggagagccccaggc

SEQ ID NO: 5779 - RNA, 21 nt, Homo sapiens
ccugugggagagccccaggcg

SEQ ID NO: 5780 - RNA, 21 nt, Homo sapiens
cugugggagagccccaggcgc

SEQ ID NO: 5781 - RNA, 21 nt, Homo sapiens
ugugggagagccccaggcgcg

SEQ ID NO: 5782 - RNA, 21 nt, Homo sapiens
gugggagagccccaggcgcgc

SEQ ID NO: 5783 - RNA, 21 nt, Homo sapiens
ugggagagccccaggcgcgca

SEQ ID NO: 5784 - RNA, 21 nt, Homo sapiens
gggagagccccaggcgcgcag

SEQ ID NO: 5785 - RNA, 21 nt, Homo sapiens
ggagagccccaggcgcgcagg

SEQ ID NO: 5786 - RNA, 21 nt, Homo sapiens
gagagccccaggcgcgcaggg

SEQ ID NO: 5787 - RNA, 21 nt, Homo sapiens
agagccccaggcgcgcagggc

SEQ ID NO: 5788 - RNA, 21 nt, Homo sapiens
gagccccaggcgcgcagggca

SEQ ID NO: 5789 - RNA, 21 nt, Homo sapiens
agccccaggcgcgcagggcac

SEQ ID NO: 5790 - RNA, 21 nt, Homo sapiens
gccccaggcgcgcagggcacg

SEQ ID NO: 5791 - RNA, 21 nt, Homo sapiens
ccccaggcgcgcagggcacgu

SEQ ID NO: 5792 - RNA, 21 nt, Homo sapiens
cccaggcgcgcagggcacgug

SEQ ID NO: 5793 - RNA, 21 nt, Homo sapiens
ccaggcgcgcagggcacgugg

SEQ ID NO: 5794 - RNA, 21 nt, Homo sapiens
caggcgcgcagggcacguggg

SEQ ID NO: 5795 - RNA, 21 nt, Homo sapiens
aggcgcgcagggcacgugggg

SEQ ID NO: 5796 - RNA, 21 nt, Homo sapiens
ggcgcgcagggcacguggggu

SEQ ID NO: 5797 - RNA, 21 nt, Homo sapiens
gcgcgcagggcacguggggug

SEQ ID NO: 5798 - RNA, 21 nt, Homo sapiens
cgcgcagggcacguggggugc

SEQ ID NO: 5799 - RNA, 21 nt, Homo sapiens
gcgcagggcacguggggugcg

SEQ ID NO: 5800 - RNA, 21 nt, Homo sapiens
cgcagggcacguggggugcgg

SEQ ID NO: 5801 - RNA, 21 nt, Homo sapiens
gcagggcacguggggugcggg

SEQ ID NO: 5802 - RNA, 21 nt, Homo sapiens
cagggcacguggggugcggga

SEQ ID NO: 5803 - RNA, 21 nt, Homo sapiens
agggcacguggggugcgggaa

SEQ ID NO: 5804 - RNA, 21 nt, Homo sapiens
gggcacguggggugcgggaag

SEQ ID NO: 5805 - RNA, 21 nt, Homo sapiens
ggcacguggggugcgggaagc

SEQ ID NO: 5806 - RNA, 21 nt, Homo sapiens
gcacguggggugcgggaagcc

SEQ ID NO: 5807 - RNA, 21 nt, Homo sapiens
cacguggggugcgggaagccc

SEQ ID NO: 5808 - RNA, 21 nt, Homo sapiens
acguggggugcgggaagcccc

SEQ ID NO: 5809 - RNA, 21 nt, Homo sapiens
cguggggugcgggaagccccg

SEQ ID NO: 5810 - RNA, 21 nt, Homo sapiens
guggggugcgggaagccccgu

SEQ ID NO: 5811 - RNA, 21 nt, Homo sapiens
uggggugcgggaagccccguu

SEQ ID NO: 5812 - RNA, 21 nt, Homo sapiens
ggggugcgggaagccccguuc

SEQ ID NO: 5813 - RNA, 21 nt, Homo sapiens
gggugcgggaagccccguucc

SEQ ID NO: 5814 - RNA, 21 nt, Homo sapiens
ggugcgggaagccccguuccc

SEQ ID NO: 5815 - RNA, 21 nt, Homo sapiens
gugcgggaagccccguucccc

SEQ ID NO: 5816 - RNA, 21 nt, Homo sapiens
ugcgggaagccccguucccca

SEQ ID NO: 5817 - RNA, 21 nt, Homo sapiens
gcgggaagccccguuccccac

SEQ ID NO: 5818 - RNA, 21 nt, Homo sapiens
cgggaagccccguuccccacg

SEQ ID NO: 5819 - RNA, 21 nt, Homo sapiens
gggaagccccguuccccacgc

SEQ ID NO: 5820 - RNA, 21 nt, Homo sapiens
ggaagccccguuccccacgcg

SEQ ID NO: 5821 - RNA, 21 nt, Homo sapiens
gaagccccguuccccacgcgc

SEQ ID NO: 5822 - RNA, 21 nt, Homo sapiens
aagccccguuccccacgcgcc

SEQ ID NO: 5823 - RNA, 21 nt, Homo sapiens
agccccguuccccacgcgccg

SEQ ID NO: 5824 - RNA, 21 nt, Homo sapiens
gccccguuccccacgcgccgg

SEQ ID NO: 5825 - RNA, 21 nt, Homo sapiens
ccccguuccccacgcgccggu

SEQ ID NO: 5826 - RNA, 21 nt, Homo sapiens
cccguuccccacgcgccggug

SEQ ID NO: 5827 - RNA, 21 nt, Homo sapiens
ccguuccccacgcgccggugu

SEQ ID NO: 5828 - RNA, 21 nt, Homo sapiens
cguuccccacgcgccggugug

SEQ ID NO: 5829 - RNA, 21 nt, Homo sapiens
guuccccacgcgccggugugg

SEQ ID NO: 5830 - RNA, 21 nt, Homo sapiens
uuccccacgcgccgguguggg

SEQ ID NO: 5831 - RNA, 21 nt, Homo sapiens
uccccacgcgccggugugggc

SEQ ID NO: 5832 - RNA, 21 nt, Homo sapiens
ccccacgcgccggugugggcg

SEQ ID NO: 5833 - RNA, 21 nt, Homo sapiens
cccacgcgccggugugggcga

SEQ ID NO: 5834 - RNA, 21 nt, Homo sapiens
ccacgcgccggugugggcgaa

SEQ ID NO: 5835 - RNA, 21 nt, Homo sapiens
cacgcgccggugugggcgaag

SEQ ID NO: 5836 - RNA, 21 nt, Homo sapiens
acgcgccggugugggcgaagg

SEQ ID NO: 5837 - RNA, 21 nt, Homo sapiens
cgcgccggugugggcgaaggc

SEQ ID NO: 5838 - RNA, 21 nt, Homo sapiens
gcgccggugugggcgaaggcg

SEQ ID NO: 5839 - RNA, 21 nt, Homo sapiens
cgccggugugggcgaaggcga

SEQ ID NO: 5840 - RNA, 21 nt, Homo sapiens
gccggugugggcgaaggcgac

SEQ ID NO: 5841 - RNA, 21 nt, Homo sapiens
ccggugugggcgaaggcgacc

SEQ ID NO: 5842 - RNA, 21 nt, Homo sapiens
cggugugggcgaaggcgaccc

SEQ ID NO: 5843 - RNA, 21 nt, Homo sapiens
ggugugggcgaaggcgaccca

SEQ ID NO: 5844 - RNA, 21 nt, Homo sapiens
gugugggcgaaggcgacccac

SEQ ID NO: 5845 - RNA, 21 nt, Homo sapiens
ugugggcgaaggcgacccacg

SEQ ID NO: 5846 - RNA, 21 nt, Homo sapiens
gugggcgaaggcgacccacga

SEQ ID NO: 5847 - RNA, 21 nt, Homo sapiens
ugggcgaaggcgacccacgag

SEQ ID NO: 5848 - RNA, 21 nt, Homo sapiens
gggcgaaggcgacccacgagg

SEQ ID NO: 5849 - RNA, 21 nt, Homo sapiens
ggcgaaggcgacccacgaggg

SEQ ID NO: 5850 - RNA, 21 nt, Homo sapiens
gcgaaggcgacccacgaggga

SEQ ID NO: 5851 - RNA, 21 nt, Homo sapiens
cgaaggcgacccacgagggag

SEQ ID NO: 5852 - RNA, 21 nt, Homo sapiens
gaaggcgacccacgagggagc

SEQ ID NO: 5853 - RNA, 21 nt, Homo sapiens
aaggcgacccacgagggagca

SEQ ID NO: 5854 - RNA, 21 nt, Homo sapiens
aggcgacccacgagggagcag

SEQ ID NO: 5855 - RNA, 21 nt, Homo sapiens
ggcgacccacgagggagcagg

SEQ ID NO: 5856 - RNA, 21 nt, Homo sapiens
gcgacccacgagggagcaggg

SEQ ID NO: 5857 - RNA, 21 nt, Homo sapiens
cgacccacgagggagcagggu

SEQ ID NO: 5858 - RNA, 21 nt, Homo sapiens
gacccacgagggagcagggug

SEQ ID NO: 5859 - RNA, 21 nt, Homo sapiens
acccacgagggagcaggguga

SEQ ID NO: 5860 - RNA, 21 nt, Homo sapiens
cccacgagggagcagggugac

SEQ ID NO: 5861 - RNA, 21 nt, Homo sapiens
ccacgagggagcagggugacc

SEQ ID NO: 5862 - RNA, 21 nt, Homo sapiens
cacgagggagcagggugaccc

SEQ ID NO: 5863 - RNA, 21 nt, Homo sapiens
acgagggagcagggugacccc

SEQ ID NO: 5864 - RNA, 21 nt, Homo sapiens
cgagggagcagggugaccccc

SEQ ID NO: 5865 - RNA, 21 nt, Homo sapiens
gagggagcagggugacccccg

SEQ ID NO: 5866 - RNA, 21 nt, Homo sapiens
agggagcagggugacccccgc

SEQ ID NO: 5867 - RNA, 21 nt, Homo sapiens
gggagcagggugacccccgcc

SEQ ID NO: 5868 - RNA, 21 nt, Homo sapiens
ggagcagggugacccccgccg

SEQ ID NO: 5869 - RNA, 21 nt, Homo sapiens
gagcagggugacccccgccgg

SEQ ID NO: 5870 - RNA, 21 nt, Homo sapiens
agcagggugacccccgccggg

SEQ ID NO: 5871 - RNA, 21 nt, Homo sapiens
gcagggugacccccgccgggg

SEQ ID NO: 5872 - RNA, 21 nt, Homo sapiens
cagggugacccccgccggggg

SEQ ID NO: 5873 - RNA, 21 nt, Homo sapiens
agggugacccccgccgggggc

SEQ ID NO: 5874 - RNA, 21 nt, Homo sapiens
gggugacccccgccgggggcc

SEQ ID NO: 5875 - RNA, 21 nt, Homo sapiens
ggugacccccgccgggggccg

SEQ ID NO: 5876 - RNA, 21 nt, Homo sapiens
gugacccccgccgggggccgc

SEQ ID NO: 5877 - RNA, 21 nt, Homo sapiens
ugacccccgccgggggccgcg

SEQ ID NO: 5878 - RNA, 21 nt, Homo sapiens
gacccccgccgggggccgcgc

SEQ ID NO: 5879 - RNA, 21 nt, Homo sapiens
acccccgccgggggccgcgcu

SEQ ID NO: 5880 - RNA, 21 nt, Homo sapiens
cccccgccgggggccgcgcug

SEQ ID NO: 5881 - RNA, 21 nt, Homo sapiens
ccccgccgggggccgcgcugc

SEQ ID NO: 5882 - RNA, 21 nt, Homo sapiens
cccgccgggggccgcgcugca

SEQ ID NO: 5883 - RNA, 21 nt, Homo sapiens
ccgccgggggccgcgcugcac

SEQ ID NO: 5884 - RNA, 21 nt, Homo sapiens
cgccgggggccgcgcugcaca

SEQ ID NO: 5885 - RNA, 21 nt, Homo sapiens
gccgggggccgcgcugcacag

SEQ ID NO: 5886 - RNA, 21 nt, Homo sapiens
ccgggggccgcgcugcacagg

SEQ ID NO: 5887 - RNA, 21 nt, Homo sapiens
cgggggccgcgcugcacaggc

SEQ ID NO: 5888 - RNA, 21 nt, Homo sapiens
gggggccgcgcugcacaggcc

SEQ ID NO: 5889 - RNA, 21 nt, Homo sapiens
ggggccgcgcugcacaggccg

SEQ ID NO: 5890 - RNA, 21 nt, Homo sapiens
gggccgcgcugcacaggccgc

SEQ ID NO: 5891 - RNA, 21 nt, Homo sapiens
ggccgcgcugcacaggccgcc

SEQ ID NO: 5892 - RNA, 21 nt, Homo sapiens
gccgcgcugcacaggccgccu

SEQ ID NO: 5893 - RNA, 21 nt, Homo sapiens
ccgcgcugcacaggccgccug

SEQ ID NO: 5894 - RNA, 21 nt, Homo sapiens
cgcgcugcacaggccgccugc

SEQ ID NO: 5895 - RNA, 21 nt, Homo sapiens
gcgcugcacaggccgccugcc

SEQ ID NO: 5896 - RNA, 21 nt, Homo sapiens
cgcugcacaggccgccugccu

SEQ ID NO: 5897 - RNA, 21 nt, Homo sapiens
gcugcacaggccgccugccug

SEQ ID NO: 5898 - RNA, 21 nt, Homo sapiens
cugcacaggccgccugccugc

SEQ ID NO: 5899 - RNA, 21 nt, Homo sapiens
ugcacaggccgccugccugcg

SEQ ID NO: 5900 - RNA, 21 nt, Homo sapiens
gcacaggccgccugccugcgc

SEQ ID NO: 5901 - RNA, 21 nt, Homo sapiens
cacaggccgccugccugcgcg

SEQ ID NO: 5902 - RNA, 21 nt, Homo sapiens
acaggccgccugccugcgcgg

SEQ ID NO: 5903 - RNA, 21 nt, Homo sapiens
caggccgccugccugcgcggg

SEQ ID NO: 5904 - RNA, 21 nt, Homo sapiens
aggccgccugccugcgcgggc

SEQ ID NO: 5905 - RNA, 21 nt, Homo sapiens
ggccgccugccugcgcgggcg

SEQ ID NO: 5906 - RNA, 21 nt, Homo sapiens
gccgccugccugcgcgggcgc

SEQ ID NO: 5907 - RNA, 21 nt, Homo sapiens
ccgccugccugcgcgggcgcc

SEQ ID NO: 5908 - RNA, 21 nt, Homo sapiens
cgccugccugcgcgggcgccc

SEQ ID NO: 5909 - RNA, 21 nt, Homo sapiens
gccugccugcgcgggcgcccu

SEQ ID NO: 5910 - RNA, 21 nt, Homo sapiens
ccugccugcgcgggcgcccug

SEQ ID NO: 5911 - RNA, 21 nt, Homo sapiens
cugccugcgcgggcgcccugc

SEQ ID NO: 5912 - RNA, 21 nt, Homo sapiens
ugccugcgcgggcgcccugcc

SEQ ID NO: 5913 - RNA, 21 nt, Homo sapiens
gccugcgcgggcgcccugcca

SEQ ID NO: 5914 - RNA, 21 nt, Homo sapiens
ccugcgcgggcgcccugccac

SEQ ID NO: 5915 - RNA, 21 nt, Homo sapiens
cugcgcgggcgcccugccacc

SEQ ID NO: 5916 - RNA, 21 nt, Homo sapiens
ugcgcgggcgcccugccaccc

SEQ ID NO: 5917 - RNA, 21 nt, Homo sapiens
gcgcgggcgcccugccacccu

SEQ ID NO: 5918 - RNA, 21 nt, Homo sapiens
cgcgggcgcccugccacccug

SEQ ID NO: 5919 - RNA, 21 nt, Homo sapiens
gcgggcgcccugccacccugu

SEQ ID NO: 5920 - RNA, 21 nt, Homo sapiens
cgggcgcccugccacccuguc

SEQ ID NO: 5921 - RNA, 21 nt, Homo sapiens
gggcgcccugccacccugucc

SEQ ID NO: 5922 - RNA, 21 nt, Homo sapiens
ggcgcccugccacccuguccc

SEQ ID NO: 5923 - RNA, 21 nt, Homo sapiens
gcgcccugccacccugucccg

SEQ ID NO: 5924 - RNA, 21 nt, Homo sapiens
cgcccugccacccugucccgg

SEQ ID NO: 5925 - RNA, 21 nt, Homo sapiens
gcccugccacccugucccggg

SEQ ID NO: 5926 - RNA, 21 nt, Homo sapiens
cccugccacccugucccgggu

SEQ ID NO: 5927 - RNA, 21 nt, Homo sapiens
ccugccacccugucccgggug

SEQ ID NO: 5928 - RNA, 21 nt, Homo sapiens
cugccacccugucccgggugc

SEQ ID NO: 5929 - RNA, 21 nt, Homo sapiens
ugccacccugucccgggugcc

SEQ ID NO: 5930 - RNA, 21 nt, Homo sapiens
gccacccugucccgggugccu

SEQ ID NO: 5931 - RNA, 21 nt, Homo sapiens
ccacccugucccgggugccug

SEQ ID NO: 5932 - RNA, 21 nt, Homo sapiens
cacccugucccgggugccugg

SEQ ID NO: 5933 - RNA, 21 nt, Homo sapiens
acccugucccgggugccuggc

SEQ ID NO: 5934 - RNA, 21 nt, Homo sapiens
cccugucccgggugccuggcc

SEQ ID NO: 5935 - RNA, 21 nt, Homo sapiens
ccugucccgggugccuggccc

SEQ ID NO: 5936 - RNA, 21 nt, Homo sapiens
cugucccgggugccuggcccu

SEQ ID NO: 5937 - RNA, 21 nt, Homo sapiens
ugucccgggugccuggcccuu

SEQ ID NO: 5938 - RNA, 21 nt, Homo sapiens
gucccgggugccuggcccuuc

SEQ ID NO: 5939 - RNA, 21 nt, Homo sapiens
ucccgggugccuggcccuucg

SEQ ID NO: 5940 - RNA, 21 nt, Homo sapiens
cccgggugccuggcccuucga

SEQ ID NO: 5941 - RNA, 21 nt, Homo sapiens
ccgggugccuggcccuucgau

SEQ ID NO: 5942 - RNA, 21 nt, Homo sapiens
cgggugccuggcccuucgauu

SEQ ID NO: 5943 - RNA, 21 nt, Homo sapiens
gggugccuggcccuucgauuc

SEQ ID NO: 5944 - RNA, 21 nt, Homo sapiens
ggugccuggcccuucgauucu

SEQ ID NO: 5945 - RNA, 21 nt, Homo sapiens
gugccuggcccuucgauucug

SEQ ID NO: 5946 - RNA, 21 nt, Homo sapiens
ugccuggcccuucgauucuga

SEQ ID NO: 5947 - RNA, 21 nt, Homo sapiens
gccuggcccuucgauucugaa

SEQ ID NO: 5948 - RNA, 21 nt, Homo sapiens
ccuggcccuucgauucugaaa

SEQ ID NO: 5949 - RNA, 21 nt, Homo sapiens
cuggcccuucgauucugaaac

SEQ ID NO: 5950 - RNA, 21 nt, Homo sapiens
uggcccuucgauucugaaacc

SEQ ID NO: 5951 - RNA, 21 nt, Homo sapiens
ggcccuucgauucugaaacca

SEQ ID NO: 5952 - RNA, 21 nt, Homo sapiens
gcccuucgauucugaaaccag

SEQ ID NO: 5953 - RNA, 21 nt, Homo sapiens
cccuucgauucugaaaccaga

SEQ ID NO: 5954 - RNA, 21 nt, Homo sapiens
ccuucgauucugaaaccagau

SEQ ID NO: 5955 - RNA, 21 nt, Homo sapiens
cuucgauucugaaaccagauc

SEQ ID NO: 5956 - RNA, 21 nt, Homo sapiens
uucgauucugaaaccagaucu

SEQ ID NO: 5957 - RNA, 21 nt, Homo sapiens
ucgauucugaaaccagaucug

SEQ ID NO: 5958 - RNA, 21 nt, Homo sapiens
cgauucugaaaccagaucuga

SEQ ID NO: 5959 - RNA, 21 nt, Homo sapiens
gauucugaaaccagaucugaa

SEQ ID NO: 5960 - RNA, 21 nt, Homo sapiens
auucugaaaccagaucugaau

SEQ ID NO: 5961 - RNA, 21 nt, Homo sapiens
uucugaaaccagaucugaauc

SEQ ID NO: 5962 - RNA, 21 nt, Homo sapiens
ucugaaaccagaucugaaucc

SEQ ID NO: 5963 - RNA, 21 nt, Homo sapiens
cugaaaccagaucugaauccu

SEQ ID NO: 5964 - RNA, 21 nt, Homo sapiens
ugaaaccagaucugaauccug

SEQ ID NO: 5965 - RNA, 21 nt, Homo sapiens
gaaaccagaucugaauccugg

SEQ ID NO: 5966 - RNA, 21 nt, Homo sapiens
aaaccagaucugaauccugga

SEQ ID NO: 5967 - RNA, 21 nt, Homo sapiens
aaccagaucugaauccuggac

SEQ ID NO: 5968 - RNA, 21 nt, Homo sapiens
accagaucugaauccuggacu

SEQ ID NO: 5969 - RNA, 21 nt, Homo sapiens
ccagaucugaauccuggacuc

SEQ ID NO: 5970 - RNA, 21 nt, Homo sapiens
cagaucugaauccuggacucc

SEQ ID NO: 5971 - RNA, 21 nt, Homo sapiens
agaucugaauccuggacuccg

SEQ ID NO: 5972 - RNA, 21 nt, Homo sapiens
gaucugaauccuggacuccgg

SEQ ID NO: 5973 - RNA, 21 nt, Homo sapiens
aucugaauccuggacuccggg

SEQ ID NO: 5974 - RNA, 21 nt, Homo sapiens
ucugaauccuggacuccggga

SEQ ID NO: 5975 - RNA, 21 nt, Homo sapiens
cugaauccuggacuccgggag

SEQ ID NO: 5976 - RNA, 21 nt, Homo sapiens
ugaauccuggacuccgggagg

SEQ ID NO: 5977 - RNA, 21 nt, Homo sapiens
gaauccuggacuccgggaggc

SEQ ID NO: 5978 - RNA, 21 nt, Homo sapiens
aauccuggacuccgggaggcc

SEQ ID NO: 5979 - RNA, 21 nt, Homo sapiens
auccuggacuccgggaggccc

SEQ ID NO: 5980 - RNA, 21 nt, Homo sapiens
uccuggacuccgggaggcccg

SEQ ID NO: 5981 - RNA, 21 nt, Homo sapiens
ccuggacuccgggaggcccgu

SEQ ID NO: 5982 - RNA, 21 nt, Homo sapiens
cuggacuccgggaggcccguc

SEQ ID NO: 5983 - RNA, 21 nt, Homo sapiens
uggacuccgggaggcccgucu

SEQ ID NO: 5984 - RNA, 21 nt, Homo sapiens
ggacuccgggaggcccgucuc

SEQ ID NO: 5985 - RNA, 21 nt, Homo sapiens
gacuccgggaggcccgucucu

SEQ ID NO: 5986 - RNA, 21 nt, Homo sapiens
acuccgggaggcccgucucuc

SEQ ID NO: 5987 - RNA, 21 nt, Homo sapiens
cuccgggaggcccgucucucu

SEQ ID NO: 5988 - RNA, 21 nt, Homo sapiens
uccgggaggcccgucucucug

SEQ ID NO: 5989 - RNA, 21 nt, Homo sapiens
ccgggaggcccgucucucugg

SEQ ID NO: 5990 - RNA, 21 nt, Homo sapiens
cgggaggcccgucucucuggc

SEQ ID NO: 5991 - RNA, 21 nt, Homo sapiens
gggaggcccgucucucuggcc

SEQ ID NO: 5992 - RNA, 21 nt, Homo sapiens
ggaggcccgucucucuggcca

SEQ ID NO: 5993 - RNA, 21 nt, Homo sapiens
gaggcccgucucucuggccag

SEQ ID NO: 5994 - RNA, 21 nt, Homo sapiens
aggcccgucucucuggccagc

SEQ ID NO: 5995 - RNA, 21 nt, Homo sapiens
ggcccgucucucuggccagcu

SEQ ID NO: 5996 - RNA, 21 nt, Homo sapiens
gcccgucucucuggccagcuc

SEQ ID NO: 5997 - RNA, 21 nt, Homo sapiens
cccgucucucuggccagcucc

SEQ ID NO: 5998 - RNA, 21 nt, Homo sapiens
ccgucucucuggccagcuccu

SEQ ID NO: 5999 - RNA, 21 nt, Homo sapiens
cgucucucuggccagcuccuc

SEQ ID NO: 6000 - RNA, 21 nt, Homo sapiens
gucucucuggccagcuccucc

SEQ ID NO: 6001 - RNA, 21 nt, Homo sapiens
ucucucuggccagcuccuccc

SEQ ID NO: 6002 - RNA, 21 nt, Homo sapiens
cucucuggccagcuccucccg

SEQ ID NO: 6003 - RNA, 21 nt, Homo sapiens
ucucuggccagcuccucccgg

SEQ ID NO: 6004 - RNA, 21 nt, Homo sapiens
cucuggccagcuccucccggg

SEQ ID NO: 6005 - RNA, 21 nt, Homo sapiens
ucuggccagcuccucccgggc

SEQ ID NO: 6006 - RNA, 21 nt, Homo sapiens
cuggccagcuccucccgggcg

SEQ ID NO: 6007 - RNA, 21 nt, Homo sapiens
uggccagcuccucccgggcgg

SEQ ID NO: 6008 - RNA, 21 nt, Homo sapiens
ggccagcuccucccgggcggc

SEQ ID NO: 6009 - RNA, 21 nt, Homo sapiens
gccagcuccucccgggcggcg

SEQ ID NO: 6010 - RNA, 21 nt, Homo sapiens
ccagcuccucccgggcggcga

SEQ ID NO: 6011 - RNA, 21 nt, Homo sapiens
cagcuccucccgggcggcgau

SEQ ID NO: 6012 - RNA, 21 nt, Homo sapiens
agcuccucccgggcggcgaug

SEQ ID NO: 6013 - RNA, 21 nt, Homo sapiens
gcuccucccgggcggcgaugc

SEQ ID NO: 6014 - RNA, 21 nt, Homo sapiens
cuccucccgggcggcgaugcc

SEQ ID NO: 6015 - RNA, 21 nt, Homo sapiens
uccucccgggcggcgaugccu

SEQ ID NO: 6016 - RNA, 21 nt, Homo sapiens
ccucccgggcggcgaugccug

SEQ ID NO: 6017 - RNA, 21 nt, Homo sapiens
cucccgggcggcgaugccugg

SEQ ID NO: 6018 - RNA, 21 nt, Homo sapiens
ucccgggcggcgaugccugga

SEQ ID NO: 6019 - RNA, 21 nt, Homo sapiens
cccgggcggcgaugccuggaa

SEQ ID NO: 6020 - RNA, 21 nt, Homo sapiens
ccgggcggcgaugccuggaaa

SEQ ID NO: 6021 - RNA, 21 nt, Homo sapiens
cgggcggcgaugccuggaaag

SEQ ID NO: 6022 - RNA, 21 nt, Homo sapiens
gggcggcgaugccuggaaagc

SEQ ID NO: 6023 - RNA, 21 nt, Homo sapiens
ggcggcgaugccuggaaagcg

SEQ ID NO: 6024 - RNA, 21 nt, Homo sapiens
gcggcgaugccuggaaagcga

SEQ ID NO: 6025 - RNA, 21 nt, Homo sapiens
cggcgaugccuggaaagcgau

SEQ ID NO: 6026 - RNA, 21 nt, Homo sapiens
ggcgaugccuggaaagcgauc

SEQ ID NO: 6027 - RNA, 21 nt, Homo sapiens
gcgaugccuggaaagcgaucc

SEQ ID NO: 6028 - RNA, 21 nt, Homo sapiens
cgaugccuggaaagcgauccu

SEQ ID NO: 6029 - RNA, 21 nt, Homo sapiens
gaugccuggaaagcgauccuu

SEQ ID NO: 6030 - RNA, 21 nt, Homo sapiens
augccuggaaagcgauccuuc

SEQ ID NO: 6031 - RNA, 21 nt, Homo sapiens
ugccuggaaagcgauccuucu

SEQ ID NO: 6032 - RNA, 21 nt, Homo sapiens
gccuggaaagcgauccuucuc

SEQ ID NO: 6033 - RNA, 21 nt, Homo sapiens
ccuggaaagcgauccuucuca

SEQ ID NO: 6034 - RNA, 21 nt, Homo sapiens
cuggaaagcgauccuucucaa

SEQ ID NO: 6035 - RNA, 21 nt, Homo sapiens
uggaaagcgauccuucucaaa

SEQ ID NO: 6036 - RNA, 21 nt, Homo sapiens
ggaaagcgauccuucucaaag

SEQ ID NO: 6037 - RNA, 21 nt, Homo sapiens
gaaagcgauccuucucaaagg

SEQ ID NO: 6038 - RNA, 21 nt, Homo sapiens
aaagcgauccuucucaaaggc

SEQ ID NO: 6039 - RNA, 21 nt, Homo sapiens
aagcgauccuucucaaaggcu

SEQ ID NO: 6040 - RNA, 21 nt, Homo sapiens
agcgauccuucucaaaggcuc

SEQ ID NO: 6041 - RNA, 21 nt, Homo sapiens
gcgauccuucucaaaggcucg

SEQ ID NO: 6042 - RNA, 21 nt, Homo sapiens
cgauccuucucaaaggcucgg

SEQ ID NO: 6043 - RNA, 21 nt, Homo sapiens
gauccuucucaaaggcucgga

SEQ ID NO: 6044 - RNA, 21 nt, Homo sapiens
auccuucucaaaggcucggag

SEQ ID NO: 6045 - RNA, 21 nt, Homo sapiens
uccuucucaaaggcucggagg

SEQ ID NO: 6046 - RNA, 21 nt, Homo sapiens
ccuucucaaaggcucggagga

SEQ ID NO: 6047 - RNA, 21 nt, Homo sapiens
cuucucaaaggcucggaggag

SEQ ID NO: 6048 - RNA, 21 nt, Homo sapiens
uucucaaaggcucggaggagc

SEQ ID NO: 6049 - RNA, 21 nt, Homo sapiens
ucucaaaggcucggaggagca

SEQ ID NO: 6050 - RNA, 21 nt, Homo sapiens
cucaaaggcucggaggagcag

SEQ ID NO: 6051 - RNA, 21 nt, Homo sapiens
ucaaaggcucggaggagcagg

SEQ ID NO: 6052 - RNA, 21 nt, Homo sapiens
caaaggcucggaggagcaggg

SEQ ID NO: 6053 - RNA, 21 nt, Homo sapiens
aaaggcucggaggagcagggc

SEQ ID NO: 6054 - RNA, 21 nt, Homo sapiens
aaggcucggaggagcagggcg

SEQ ID NO: 6055 - RNA, 21 nt, Homo sapiens
aggcucggaggagcagggcgg

SEQ ID NO: 6056 - RNA, 21 nt, Homo sapiens
ggcucggaggagcagggcggu

SEQ ID NO: 6057 - RNA, 21 nt, Homo sapiens
gcucggaggagcagggcgguc

SEQ ID NO: 6058 - RNA, 21 nt, Homo sapiens
cucggaggagcagggcggucu

SEQ ID NO: 6059 - RNA, 21 nt, Homo sapiens
ucggaggagcagggcggucug

SEQ ID NO: 6060 - RNA, 21 nt, Homo sapiens
cggaggagcagggcggucugg

SEQ ID NO: 6061 - RNA, 21 nt, Homo sapiens
ggaggagcagggcggucuggg

SEQ ID NO: 6062 - RNA, 21 nt, Homo sapiens
gaggagcagggcggucuggga

SEQ ID NO: 6063 - RNA, 21 nt, Homo sapiens
aggagcagggcggucugggau

SEQ ID NO: 6064 - RNA, 21 nt, Homo sapiens
ggagcagggcggucugggauc

SEQ ID NO: 6065 - RNA, 21 nt, Homo sapiens
gagcagggcggucugggaucc

SEQ ID NO: 6066 - RNA, 21 nt, Homo sapiens
agcagggcggucugggauccg

SEQ ID NO: 6067 - RNA, 21 nt, Homo sapiens
gcagggcggucugggauccgg

SEQ ID NO: 6068 - RNA, 21 nt, Homo sapiens
cagggcggucugggauccggu

SEQ ID NO: 6069 - RNA, 21 nt, Homo sapiens
agggcggucugggauccggug

SEQ ID NO: 6070 - RNA, 21 nt, Homo sapiens
gggcggucugggauccgguga

SEQ ID NO: 6071 - RNA, 21 nt, Homo sapiens
ggcggucugggauccggugac

SEQ ID NO: 6072 - RNA, 21 nt, Homo sapiens
gcggucugggauccggugacg

SEQ ID NO: 6073 - RNA, 21 nt, Homo sapiens
cggucugggauccggugacgg

SEQ ID NO: 6074 - RNA, 21 nt, Homo sapiens
ggucugggauccggugacggc

SEQ ID NO: 6075 - RNA, 21 nt, Homo sapiens
gucugggauccggugacggcg

SEQ ID NO: 6076 - RNA, 21 nt, Homo sapiens
ucugggauccggugacggcgg

SEQ ID NO: 6077 - RNA, 21 nt, Homo sapiens
cugggauccggugacggcggu

SEQ ID NO: 6078 - RNA, 21 nt, Homo sapiens
ugggauccggugacggcgguc

SEQ ID NO: 6079 - RNA, 21 nt, Homo sapiens
gggauccggugacggcggucc

SEQ ID NO: 6080 - RNA, 21 nt, Homo sapiens
ggauccggugacggcgguccg

SEQ ID NO: 6081 - RNA, 21 nt, Homo sapiens
gauccggugacggcgguccgc

SEQ ID NO: 6082 - RNA, 21 nt, Homo sapiens
auccggugacggcgguccgcu

SEQ ID NO: 6083 - RNA, 21 nt, Homo sapiens
uccggugacggcgguccgcuu

SEQ ID NO: 6084 - RNA, 21 nt, Homo sapiens
ccggugacggcgguccgcuuu

SEQ ID NO: 6085 - RNA, 21 nt, Homo sapiens
cggugacggcgguccgcuuuc

SEQ ID NO: 6086 - RNA, 21 nt, Homo sapiens
ggugacggcgguccgcuuucg

SEQ ID NO: 6087 - RNA, 21 nt, Homo sapiens
gugacggcgguccgcuuucgc

SEQ ID NO: 6088 - RNA, 21 nt, Homo sapiens
ugacggcgguccgcuuucgcc

SEQ ID NO: 6089 - RNA, 21 nt, Homo sapiens
gacggcgguccgcuuucgccg

SEQ ID NO: 6090 - RNA, 21 nt, Homo sapiens
acggcgguccgcuuucgccgg

SEQ ID NO: 6091 - RNA, 21 nt, Homo sapiens
cggcgguccgcuuucgccggc

SEQ ID NO: 6092 - RNA, 21 nt, Homo sapiens
ggcgguccgcuuucgccggcc

SEQ ID NO: 6093 - RNA, 21 nt, Homo sapiens
gcgguccgcuuucgccggccu

SEQ ID NO: 6094 - RNA, 21 nt, Homo sapiens
cgguccgcuuucgccggccuu

SEQ ID NO: 6095 - RNA, 21 nt, Homo sapiens
gguccgcuuucgccggccuuc

SEQ ID NO: 6096 - RNA, 21 nt, Homo sapiens
guccgcuuucgccggccuucu

SEQ ID NO: 6097 - RNA, 21 nt, Homo sapiens
uccgcuuucgccggccuucug

SEQ ID NO: 6098 - RNA, 21 nt, Homo sapiens
ccgcuuucgccggccuucugg

SEQ ID NO: 6099 - RNA, 21 nt, Homo sapiens
cgcuuucgccggccuucuggc

SEQ ID NO: 6100 - RNA, 21 nt, Homo sapiens
gcuuucgccggccuucuggcg

SEQ ID NO: 6101 - RNA, 21 nt, Homo sapiens
cuuucgccggccuucuggcgg

SEQ ID NO: 6102 - RNA, 21 nt, Homo sapiens
uuucgccggccuucuggcggg

SEQ ID NO: 6103 - RNA, 21 nt, Homo sapiens
uucgccggccuucuggcgggc

SEQ ID NO: 6104 - RNA, 21 nt, Homo sapiens
ucgccggccuucuggcgggcc

SEQ ID NO: 6105 - RNA, 21 nt, Homo sapiens
cgccggccuucuggcgggccg

SEQ ID NO: 6106 - RNA, 21 nt, Homo sapiens
gccggccuucuggcgggccgc

SEQ ID NO: 6107 - RNA, 21 nt, Homo sapiens
ccggccuucuggcgggccgcg

SEQ ID NO: 6108 - RNA, 21 nt, Homo sapiens
cggccuucuggcgggccgcgu

SEQ ID NO: 6109 - RNA, 21 nt, Homo sapiens
ggccuucuggcgggccgcguc

SEQ ID NO: 6110 - RNA, 21 nt, Homo sapiens
gccuucuggcgggccgcgucu

SEQ ID NO: 6111 - RNA, 21 nt, Homo sapiens
ccuucuggcgggccgcgucuc

SEQ ID NO: 6112 - RNA, 21 nt, Homo sapiens
cuucuggcgggccgcgucucc

SEQ ID NO: 6113 - RNA, 21 nt, Homo sapiens
uucuggcgggccgcgucuccc

SEQ ID NO: 6114 - RNA, 21 nt, Homo sapiens
ucuggcgggccgcgucucccg

SEQ ID NO: 6115 - RNA, 21 nt, Homo sapiens
cuggcgggccgcgucucccgg

SEQ ID NO: 6116 - RNA, 21 nt, Homo sapiens
uggcgggccgcgucucccggg

SEQ ID NO: 6117 - RNA, 21 nt, Homo sapiens
ggcgggccgcgucucccgggc

SEQ ID NO: 6118 - RNA, 21 nt, Homo sapiens
gcgggccgcgucucccgggcc

SEQ ID NO: 6119 - RNA, 21 nt, Homo sapiens
cgggccgcgucucccgggcca

SEQ ID NO: 6120 - RNA, 21 nt, Homo sapiens
gggccgcgucucccgggccag

SEQ ID NO: 6121 - RNA, 21 nt, Homo sapiens
ggccgcgucucccgggccagg

SEQ ID NO: 6122 - RNA, 21 nt, Homo sapiens
gccgcgucucccgggccaggg

SEQ ID NO: 6123 - RNA, 21 nt, Homo sapiens
ccgcgucucccgggccagggc

SEQ ID NO: 6124 - RNA, 21 nt, Homo sapiens
cgcgucucccgggccagggcc

SEQ ID NO: 6125 - RNA, 21 nt, Homo sapiens
gcgucucccgggccagggccg

SEQ ID NO: 6126 - RNA, 21 nt, Homo sapiens
cgucucccgggccagggccga

SEQ ID NO: 6127 - RNA, 21 nt, Homo sapiens
gucucccgggccagggccgag

SEQ ID NO: 6128 - RNA, 21 nt, Homo sapiens
ucucccgggccagggccgaga

SEQ ID NO: 6129 - RNA, 21 nt, Homo sapiens
cucccgggccagggccgagau

SEQ ID NO: 6130 - RNA, 21 nt, Homo sapiens
ucccgggccagggccgagauu

SEQ ID NO: 6131 - RNA, 21 nt, Homo sapiens
cccgggccagggccgagauuc

SEQ ID NO: 6132 - RNA, 21 nt, Homo sapiens
ccgggccagggccgagauucc

SEQ ID NO: 6133 - RNA, 21 nt, Homo sapiens
cgggccagggccgagauuccc

SEQ ID NO: 6134 - RNA, 21 nt, Homo sapiens
gggccagggccgagauucccg

SEQ ID NO: 6135 - RNA, 21 nt, Homo sapiens
ggccagggccgagauucccgc

SEQ ID NO: 6136 - RNA, 21 nt, Homo sapiens
gccagggccgagauucccgcc

SEQ ID NO: 6137 - RNA, 21 nt, Homo sapiens
ccagggccgagauucccgccg

SEQ ID NO: 6138 - RNA, 21 nt, Homo sapiens
cagggccgagauucccgccgg

SEQ ID NO: 6139 - RNA, 21 nt, Homo sapiens
agggccgagauucccgccggu

SEQ ID NO: 6140 - RNA, 21 nt, Homo sapiens
gggccgagauucccgccggug

SEQ ID NO: 6141 - RNA, 21 nt, Homo sapiens
ggccgagauucccgccggugc

SEQ ID NO: 6142 - RNA, 21 nt, Homo sapiens
gccgagauucccgccggugcu

SEQ ID NO: 6143 - RNA, 21 nt, Homo sapiens
ccgagauucccgccggugcug

SEQ ID NO: 6144 - RNA, 21 nt, Homo sapiens
cgagauucccgccggugcugc

SEQ ID NO: 6145 - RNA, 21 nt, Homo sapiens
gagauucccgccggugcugcc

SEQ ID NO: 6146 - RNA, 21 nt, Homo sapiens
agauucccgccggugcugccu

SEQ ID NO: 6147 - RNA, 21 nt, Homo sapiens
gauucccgccggugcugccuc

SEQ ID NO: 6148 - RNA, 21 nt, Homo sapiens
auucccgccggugcugccuca

SEQ ID NO: 6149 - RNA, 21 nt, Homo sapiens
uucccgccggugcugccucag

SEQ ID NO: 6150 - RNA, 21 nt, Homo sapiens
ucccgccggugcugccucagc

SEQ ID NO: 6151 - RNA, 21 nt, Homo sapiens
cccgccggugcugccucagcu

SEQ ID NO: 6152 - RNA, 21 nt, Homo sapiens
ccgccggugcugccucagcug

SEQ ID NO: 6153 - RNA, 21 nt, Homo sapiens
cgccggugcugccucagcugg

SEQ ID NO: 6154 - RNA, 21 nt, Homo sapiens
gccggugcugccucagcuggc

SEQ ID NO: 6155 - RNA, 21 nt, Homo sapiens
ccggugcugccucagcuggcg

SEQ ID NO: 6156 - RNA, 21 nt, Homo sapiens
cggugcugccucagcuggcgu

SEQ ID NO: 6157 - RNA, 21 nt, Homo sapiens
ggugcugccucagcuggcgug

SEQ ID NO: 6158 - RNA, 21 nt, Homo sapiens
gugcugccucagcuggcguga

SEQ ID NO: 6159 - RNA, 21 nt, Homo sapiens
ugcugccucagcuggcgugac

SEQ ID NO: 6160 - RNA, 21 nt, Homo sapiens
gcugccucagcuggcgugacc

SEQ ID NO: 6161 - RNA, 21 nt, Homo sapiens
cugccucagcuggcgugaccu

SEQ ID NO: 6162 - RNA, 21 nt, Homo sapiens
ugccucagcuggcgugaccuc

SEQ ID NO: 6163 - RNA, 21 nt, Homo sapiens
gccucagcuggcgugaccucu

SEQ ID NO: 6164 - RNA, 21 nt, Homo sapiens
ccucagcuggcgugaccucuc

SEQ ID NO: 6165 - RNA, 21 nt, Homo sapiens
cucagcuggcgugaccucuca

SEQ ID NO: 6166 - RNA, 21 nt, Homo sapiens
ucagcuggcgugaccucucau

SEQ ID NO: 6167 - RNA, 21 nt, Homo sapiens
cagcuggcgugaccucucauu

SEQ ID NO: 6168 - RNA, 21 nt, Homo sapiens
agcuggcgugaccucucauuc

SEQ ID NO: 6169 - RNA, 21 nt, Homo sapiens
gcuggcgugaccucucauucu

SEQ ID NO: 6170 - RNA, 21 nt, Homo sapiens
cuggcgugaccucucauucug

SEQ ID NO: 6171 - RNA, 21 nt, Homo sapiens
uggcgugaccucucauucuga

SEQ ID NO: 6172 - RNA, 21 nt, Homo sapiens
ggcgugaccucucauucugaa

SEQ ID NO: 6173 - RNA, 21 nt, Homo sapiens
gcgugaccucucauucugaaa

SEQ ID NO: 6174 - RNA, 21 nt, Homo sapiens
cgugaccucucauucugaaac

SEQ ID NO: 6175 - RNA, 21 nt, Homo sapiens
gugaccucucauucugaaacc

SEQ ID NO: 6176 - RNA, 21 nt, Homo sapiens
ugaccucucauucugaaacca

SEQ ID NO: 6177 - RNA, 21 nt, Homo sapiens
gaccucucauucugaaaccaa

SEQ ID NO: 6178 - RNA, 21 nt, Homo sapiens
accucucauucugaaaccaaa

SEQ ID NO: 6179 - RNA, 21 nt, Homo sapiens
ccucucauucugaaaccaaau

SEQ ID NO: 6180 - RNA, 21 nt, Homo sapiens
cucucauucugaaaccaaauc

SEQ ID NO: 6181 - RNA, 21 nt, Homo sapiens
ucucauucugaaaccaaaucu

SEQ ID NO: 6182 - RNA, 21 nt, Homo sapiens
cucauucugaaaccaaaucug

SEQ ID NO: 6183 - RNA, 21 nt, Homo sapiens
ucauucugaaaccaaaucugg

SEQ ID NO: 6184 - RNA, 21 nt, Homo sapiens
cauucugaaaccaaaucugga

SEQ ID NO: 6185 - RNA, 21 nt, Homo sapiens
auucugaaaccaaaucuggac

SEQ ID NO: 6186 - RNA, 21 nt, Homo sapiens
uucugaaaccaaaucuggacc

SEQ ID NO: 6187 - RNA, 21 nt, Homo sapiens
ucugaaaccaaaucuggaccc

SEQ ID NO: 6188 - RNA, 21 nt, Homo sapiens
cugaaaccaaaucuggacccu

SEQ ID NO: 6189 - RNA, 21 nt, Homo sapiens
ugaaaccaaaucuggacccug

SEQ ID NO: 6190 - RNA, 21 nt, Homo sapiens
gaaaccaaaucuggacccugg

SEQ ID NO: 6191 - RNA, 21 nt, Homo sapiens
aaaccaaaucuggacccuggg

SEQ ID NO: 6192 - RNA, 21 nt, Homo sapiens
aaccaaaucuggacccugggc

SEQ ID NO: 6193 - RNA, 21 nt, Homo sapiens
accaaaucuggacccugggcu

SEQ ID NO: 6194 - RNA, 21 nt, Homo sapiens
ccaaaucuggacccugggcuc

SEQ ID NO: 6195 - RNA, 21 nt, Homo sapiens
caaaucuggacccugggcucc

SEQ ID NO: 6196 - RNA, 21 nt, Homo sapiens
aaaucuggacccugggcuccg

SEQ ID NO: 6197 - RNA, 21 nt, Homo sapiens
aaucuggacccugggcuccgg

SEQ ID NO: 6198 - RNA, 21 nt, Homo sapiens
aucuggacccugggcuccgga

SEQ ID NO: 6199 - RNA, 21 nt, Homo sapiens
ucuggacccugggcuccggaa

SEQ ID NO: 6200 - RNA, 21 nt, Homo sapiens
cuggacccugggcuccggaau

SEQ ID NO: 6201 - RNA, 21 nt, Homo sapiens
uggacccugggcuccggaaug

SEQ ID NO: 6202 - RNA, 21 nt, Homo sapiens
ggacccugggcuccggaaugc

SEQ ID NO: 6203 - RNA, 21 nt, Homo sapiens
gacccugggcuccggaaugcc

SEQ ID NO: 6204 - RNA, 21 nt, Homo sapiens
acccugggcuccggaaugccg

SEQ ID NO: 6205 - RNA, 21 nt, Homo sapiens
cccugggcuccggaaugccga

SEQ ID NO: 6206 - RNA, 21 nt, Homo sapiens
ccugggcuccggaaugccgau

SEQ ID NO: 6207 - RNA, 21 nt, Homo sapiens
cugggcuccggaaugccgaug

SEQ ID NO: 6208 - RNA, 21 nt, Homo sapiens
ugggcuccggaaugccgaugg

SEQ ID NO: 6209 - RNA, 21 nt, Homo sapiens
gggcuccggaaugccgauggc

SEQ ID NO: 6210 - RNA, 21 nt, Homo sapiens
ggcuccggaaugccgauggcc

SEQ ID NO: 6211 - RNA, 21 nt, Homo sapiens
gcuccggaaugccgauggccu

SEQ ID NO: 6212 - RNA, 21 nt, Homo sapiens
cuccggaaugccgauggccug

SEQ ID NO: 6213 - RNA, 21 nt, Homo sapiens
uccggaaugccgauggccugg

SEQ ID NO: 6214 - RNA, 21 nt, Homo sapiens
ccggaaugccgauggccuggg

SEQ ID NO: 6215 - RNA, 21 nt, Homo sapiens
cggaaugccgauggccugggc

SEQ ID NO: 6216 - RNA, 21 nt, Homo sapiens
ggaaugccgauggccugggcc

SEQ ID NO: 6217 - RNA, 21 nt, Homo sapiens
gaaugccgauggccugggcca

SEQ ID NO: 6218 - RNA, 21 nt, Homo sapiens
aaugccgauggccugggccag

SEQ ID NO: 6219 - RNA, 21 nt, Homo sapiens
augccgauggccugggccagc

SEQ ID NO: 6220 - RNA, 21 nt, Homo sapiens
ugccgauggccugggccagcc

SEQ ID NO: 6221 - RNA, 21 nt, Homo sapiens
gccgauggccugggccagccg

SEQ ID NO: 6222 - RNA, 21 nt, Homo sapiens
ccgauggccugggccagccgu

SEQ ID NO: 6223 - RNA, 21 nt, Homo sapiens
cgauggccugggccagccguu

SEQ ID NO: 6224 - RNA, 21 nt, Homo sapiens
gauggccugggccagccguuc

SEQ ID NO: 6225 - RNA, 21 nt, Homo sapiens
auggccugggccagccguucu

SEQ ID NO: 6226 - RNA, 21 nt, Homo sapiens
uggccugggccagccguucuc

SEQ ID NO: 6227 - RNA, 21 nt, Homo sapiens
ggccugggccagccguucucu

SEQ ID NO: 6228 - RNA, 21 nt, Homo sapiens
gccugggccagccguucucug

SEQ ID NO: 6229 - RNA, 21 nt, Homo sapiens
ccugggccagccguucucugg

SEQ ID NO: 6230 - RNA, 21 nt, Homo sapiens
cugggccagccguucucuggu

SEQ ID NO: 6231 - RNA, 21 nt, Homo sapiens
ugggccagccguucucuggug

SEQ ID NO: 6232 - RNA, 21 nt, Homo sapiens
gggccagccguucucuggugg

SEQ ID NO: 6233 - RNA, 21 nt, Homo sapiens
ggccagccguucucugguggc

SEQ ID NO: 6234 - RNA, 21 nt, Homo sapiens
gccagccguucucugguggcg

SEQ ID NO: 6235 - RNA, 21 nt, Homo sapiens
ccagccguucucugguggcga

SEQ ID NO: 6236 - RNA, 21 nt, Homo sapiens
cagccguucucugguggcgau

SEQ ID NO: 6237 - RNA, 21 nt, Homo sapiens
agccguucucugguggcgaug

SEQ ID NO: 6238 - RNA, 21 nt, Homo sapiens
gccguucucugguggcgaugc

SEQ ID NO: 6239 - RNA, 21 nt, Homo sapiens
ccguucucugguggcgaugcc

SEQ ID NO: 6240 - RNA, 21 nt, Homo sapiens
cguucucugguggcgaugccc

SEQ ID NO: 6241 - RNA, 21 nt, Homo sapiens
guucucugguggcgaugcccg

SEQ ID NO: 6242 - RNA, 21 nt, Homo sapiens
uucucugguggcgaugcccgg

SEQ ID NO: 6243 - RNA, 21 nt, Homo sapiens
ucucugguggcgaugcccggg

SEQ ID NO: 6244 - RNA, 21 nt, Homo sapiens
cucugguggcgaugcccgggu

SEQ ID NO: 6245 - RNA, 21 nt, Homo sapiens
ucugguggcgaugcccgggua

SEQ ID NO: 6246 - RNA, 21 nt, Homo sapiens
cugguggcgaugcccggguac

SEQ ID NO: 6247 - RNA, 21 nt, Homo sapiens
ugguggcgaugcccggguacg

SEQ ID NO: 6248 - RNA, 21 nt, Homo sapiens
gguggcgaugcccggguacgg

SEQ ID NO: 6249 - RNA, 21 nt, Homo sapiens
guggcgaugcccggguacggg

SEQ ID NO: 6250 - RNA, 21 nt, Homo sapiens
uggcgaugcccggguacgggu

SEQ ID NO: 6251 - RNA, 21 nt, Homo sapiens
ggcgaugcccggguacggguu

SEQ ID NO: 6252 - RNA, 21 nt, Homo sapiens
gcgaugcccggguacggguuc

SEQ ID NO: 6253 - RNA, 21 nt, Homo sapiens
cgaugcccggguacggguucc

SEQ ID NO: 6254 - RNA, 21 nt, Homo sapiens
gaugcccggguacggguuccg

SEQ ID NO: 6255 - RNA, 21 nt, Homo sapiens
augcccggguacggguuccgc

SEQ ID NO: 6256 - RNA, 21 nt, Homo sapiens
ugcccggguacggguuccgcu

SEQ ID NO: 6257 - RNA, 21 nt, Homo sapiens
gcccggguacggguuccgcuc

SEQ ID NO: 6258 - RNA, 21 nt, Homo sapiens
cccggguacggguuccgcuca

SEQ ID NO: 6259 - RNA, 21 nt, Homo sapiens
ccggguacggguuccgcucaa

SEQ ID NO: 6260 - RNA, 21 nt, Homo sapiens
cggguacggguuccgcucaaa

SEQ ID NO: 6261 - RNA, 21 nt, Homo sapiens
ggguacggguuccgcucaaag

SEQ ID NO: 6262 - RNA, 21 nt, Homo sapiens
gguacggguuccgcucaaagc

SEQ ID NO: 6263 - RNA, 21 nt, Homo sapiens
guacggguuccgcucaaagca

SEQ ID NO: 6264 - RNA, 21 nt, Homo sapiens
uacggguuccgcucaaagcag

SEQ ID NO: 6265 - RNA, 21 nt, Homo sapiens
acggguuccgcucaaagcagg

SEQ ID NO: 6266 - RNA, 21 nt, Homo sapiens
cggguuccgcucaaagcaggc

SEQ ID NO: 6267 - RNA, 21 nt, Homo sapiens
ggguuccgcucaaagcaggcu

SEQ ID NO: 6268 - RNA, 21 nt, Homo sapiens
gguuccgcucaaagcaggcuc

SEQ ID NO: 6269 - RNA, 21 nt, Homo sapiens
guuccgcucaaagcaggcucg

SEQ ID NO: 6270 - RNA, 21 nt, Homo sapiens
uuccgcucaaagcaggcucgc

SEQ ID NO: 6271 - RNA, 21 nt, Homo sapiens
uccgcucaaagcaggcucgca

SEQ ID NO: 6272 - RNA, 21 nt, Homo sapiens
ccgcucaaagcaggcucgcag

SEQ ID NO: 6273 - RNA, 21 nt, Homo sapiens
cgcucaaagcaggcucgcagg

SEQ ID NO: 6274 - RNA, 21 nt, Homo sapiens
gcucaaagcaggcucgcaggg

SEQ ID NO: 6275 - RNA, 21 nt, Homo sapiens
cucaaagcaggcucgcagggc

SEQ ID NO: 6276 - RNA, 21 nt, Homo sapiens
ucaaagcaggcucgcagggcc

SEQ ID NO: 6277 - RNA, 21 nt, Homo sapiens
caaagcaggcucgcagggccu

SEQ ID NO: 6278 - RNA, 21 nt, Homo sapiens
aaagcaggcucgcagggccuc

SEQ ID NO: 6279 - RNA, 21 nt, Homo sapiens
aagcaggcucgcagggccucg

SEQ ID NO: 6280 - RNA, 21 nt, Homo sapiens
agcaggcucgcagggccucgc

SEQ ID NO: 6281 - RNA, 21 nt, Homo sapiens
gcaggcucgcagggccucgcu

SEQ ID NO: 6282 - RNA, 21 nt, Homo sapiens
caggcucgcagggccucgcuu

SEQ ID NO: 6283 - RNA, 21 nt, Homo sapiens
aggcucgcagggccucgcuuu

SEQ ID NO: 6284 - RNA, 21 nt, Homo sapiens
ggcucgcagggccucgcuuug

SEQ ID NO: 6285 - RNA, 21 nt, Homo sapiens
gcucgcagggccucgcuuugg

SEQ ID NO: 6286 - RNA, 21 nt, Homo sapiens
cucgcagggccucgcuuuggc

SEQ ID NO: 6287 - RNA, 21 nt, Homo sapiens
ucgcagggccucgcuuuggcu

SEQ ID NO: 6288 - RNA, 21 nt, Homo sapiens
cgcagggccucgcuuuggcuc

SEQ ID NO: 6289 - RNA, 21 nt, Homo sapiens
gcagggccucgcuuuggcucg

SEQ ID NO: 6290 - RNA, 21 nt, Homo sapiens
cagggccucgcuuuggcucgg

SEQ ID NO: 6291 - RNA, 21 nt, Homo sapiens
agggccucgcuuuggcucggg

SEQ ID NO: 6292 - RNA, 21 nt, Homo sapiens
gggccucgcuuuggcucgggg

SEQ ID NO: 6293 - RNA, 21 nt, Homo sapiens
ggccucgcuuuggcucggggu

SEQ ID NO: 6294 - RNA, 21 nt, Homo sapiens
gccucgcuuuggcucgggguc

SEQ ID NO: 6295 - RNA, 21 nt, Homo sapiens
ccucgcuuuggcucggggucc

SEQ ID NO: 6296 - RNA, 21 nt, Homo sapiens
cucgcuuuggcucggggucca

SEQ ID NO: 6297 - RNA, 21 nt, Homo sapiens
ucgcuuuggcucgggguccaa

SEQ ID NO: 6298 - RNA, 21 nt, Homo sapiens
cgcuuuggcucgggguccaaa

SEQ ID NO: 6299 - RNA, 21 nt, Homo sapiens
gcuuuggcucgggguccaaac

SEQ ID NO: 6300 - RNA, 21 nt, Homo sapiens
cuuuggcucgggguccaaacg

SEQ ID NO: 6301 - RNA, 21 nt, Homo sapiens
uuuggcucgggguccaaacga

SEQ ID NO: 6302 - RNA, 21 nt, Homo sapiens
uuggcucgggguccaaacgag

SEQ ID NO: 6303 - RNA, 21 nt, Homo sapiens
uggcucgggguccaaacgagu

SEQ ID NO: 6304 - RNA, 21 nt, Homo sapiens
ggcucgggguccaaacgaguc

SEQ ID NO: 6305 - RNA, 21 nt, Homo sapiens
gcucgggguccaaacgagucu

SEQ ID NO: 6306 - RNA, 21 nt, Homo sapiens
cucgggguccaaacgagucuc

SEQ ID NO: 6307 - RNA, 21 nt, Homo sapiens
ucgggguccaaacgagucucc

SEQ ID NO: 6308 - RNA, 21 nt, Homo sapiens
cgggguccaaacgagucuccg

SEQ ID NO: 6309 - RNA, 21 nt, Homo sapiens
gggguccaaacgagucuccgu

SEQ ID NO: 6310 - RNA, 21 nt, Homo sapiens
ggguccaaacgagucuccguc

SEQ ID NO: 6311 - RNA, 21 nt, Homo sapiens
gguccaaacgagucuccgucg

SEQ ID NO: 6312 - RNA, 21 nt, Homo sapiens
guccaaacgagucuccgucgc

SEQ ID NO: 6313 - RNA, 21 nt, Homo sapiens
uccaaacgagucuccgucgcc

SEQ ID NO: 6314 - RNA, 21 nt, Homo sapiens
ccaaacgagucuccgucgccg

SEQ ID NO: 6315 - RNA, 21 nt, Homo sapiens
caaacgagucuccgucgccgu

SEQ ID NO: 6316 - RNA, 21 nt, Homo sapiens
aaacgagucuccgucgccguc

SEQ ID NO: 6317 - RNA, 21 nt, Homo sapiens
aacgagucuccgucgccgucc

SEQ ID NO: 6318 - RNA, 21 nt, Homo sapiens
acgagucuccgucgccguccu

SEQ ID NO: 6319 - RNA, 21 nt, Homo sapiens
cgagucuccgucgccguccuc

SEQ ID NO: 6320 - RNA, 21 nt, Homo sapiens
gagucuccgucgccguccucg

SEQ ID NO: 6321 - RNA, 21 nt, Homo sapiens
agucuccgucgccguccucgu

SEQ ID NO: 6322 - RNA, 21 nt, Homo sapiens
gucuccgucgccguccucguc

SEQ ID NO: 6323 - RNA, 21 nt, Homo sapiens
ucuccgucgccguccucgucc

SEQ ID NO: 6324 - RNA, 21 nt, Homo sapiens
cuccgucgccguccucguccc

SEQ ID NO: 6325 - RNA, 21 nt, Homo sapiens
uccgucgccguccucgucccc

SEQ ID NO: 6326 - RNA, 21 nt, Homo sapiens
ccgucgccguccucguccccg

SEQ ID NO: 6327 - RNA, 21 nt, Homo sapiens
cgucgccguccucguccccgg

SEQ ID NO: 6328 - RNA, 21 nt, Homo sapiens
gucgccguccucguccccggg

SEQ ID NO: 6329 - RNA, 21 nt, Homo sapiens
ucgccguccucguccccgggc

SEQ ID NO: 6330 - RNA, 21 nt, Homo sapiens
cgccguccucguccccgggcu

SEQ ID NO: 6331 - RNA, 21 nt, Homo sapiens
gccguccucguccccgggcuu

SEQ ID NO: 6332 - RNA, 21 nt, Homo sapiens
ccguccucguccccgggcuuc

SEQ ID NO: 6333 - RNA, 21 nt, Homo sapiens
cguccucguccccgggcuucc

SEQ ID NO: 6334 - RNA, 21 nt, Homo sapiens
guccucguccccgggcuuccg

SEQ ID NO: 6335 - RNA, 21 nt, Homo sapiens
uccucguccccgggcuuccgc

SEQ ID NO: 6336 - RNA, 21 nt, Homo sapiens
ccucguccccgggcuuccgcg

SEQ ID NO: 6337 - RNA, 21 nt, Homo sapiens
cucguccccgggcuuccgcgg

SEQ ID NO: 6338 - RNA, 21 nt, Homo sapiens
ucguccccgggcuuccgcggg

SEQ ID NO: 6339 - RNA, 21 nt, Homo sapiens
cguccccgggcuuccgcgggg

SEQ ID NO: 6340 - RNA, 21 nt, Homo sapiens
guccccgggcuuccgcgggga

SEQ ID NO: 6341 - RNA, 21 nt, Homo sapiens
uccccgggcuuccgcggggag

SEQ ID NO: 6342 - RNA, 21 nt, Homo sapiens
ccccgggcuuccgcggggagg

SEQ ID NO: 6343 - RNA, 21 nt, Homo sapiens
cccgggcuuccgcggggaggg

SEQ ID NO: 6344 - RNA, 21 nt, Homo sapiens
ccgggcuuccgcggggagggu

SEQ ID NO: 6345 - RNA, 21 nt, Homo sapiens
cgggcuuccgcggggagggug

SEQ ID NO: 6346 - RNA, 21 nt, Homo sapiens
gggcuuccgcggggagggugc

SEQ ID NO: 6347 - RNA, 21 nt, Homo sapiens
ggcuuccgcggggagggugcu

SEQ ID NO: 6348 - RNA, 21 nt, Homo sapiens
gcuuccgcggggagggugcug

SEQ ID NO: 6349 - RNA, 21 nt, Homo sapiens
cuuccgcggggagggugcugu

SEQ ID NO: 6350 - RNA, 21 nt, Homo sapiens
uuccgcggggagggugcuguc

SEQ ID NO: 6351 - RNA, 21 nt, Homo sapiens
uccgcggggagggugcugucc

SEQ ID NO: 6352 - RNA, 21 nt, Homo sapiens
ccgcggggagggugcuguccg

SEQ ID NO: 6353 - RNA, 21 nt, Homo sapiens
cgcggggagggugcuguccga

SEQ ID NO: 6354 - RNA, 21 nt, Homo sapiens
gcggggagggugcuguccgag

SEQ ID NO: 6355 - RNA, 21 nt, Homo sapiens
cggggagggugcuguccgagg

SEQ ID NO: 6356 - RNA, 21 nt, Homo sapiens
ggggagggugcuguccgaggg

SEQ ID NO: 6357 - RNA, 21 nt, Homo sapiens
gggagggugcuguccgagggu

SEQ ID NO: 6358 - RNA, 21 nt, Homo sapiens
ggagggugcuguccgagggug

SEQ ID NO: 6359 - RNA, 21 nt, Homo sapiens
gagggugcuguccgagggugu

SEQ ID NO: 6360 - RNA, 21 nt, Homo sapiens
agggugcuguccgaggguguc

SEQ ID NO: 6361 - RNA, 21 nt, Homo sapiens
gggugcuguccgagggugucg

SEQ ID NO: 6362 - RNA, 21 nt, Homo sapiens
ggugcuguccgagggugucgg

SEQ ID NO: 6363 - RNA, 21 nt, Homo sapiens
gugcuguccgagggugucggg

SEQ ID NO: 6364 - RNA, 21 nt, Homo sapiens
ugcuguccgagggugucggga

SEQ ID NO: 6365 - RNA, 21 nt, Homo sapiens
gcuguccgagggugucgggag

SEQ ID NO: 6366 - RNA, 21 nt, Homo sapiens
cuguccgagggugucgggagg

SEQ ID NO: 6367 - RNA, 21 nt, Homo sapiens
uguccgagggugucgggaggg

SEQ ID NO: 6368 - RNA, 21 nt, Homo sapiens
guccgagggugucgggagggc

SEQ ID NO: 6369 - RNA, 21 nt, Homo sapiens
uccgagggugucgggagggcc

SEQ ID NO: 6370 - RNA, 21 nt, Homo sapiens
ccgagggugucgggagggcca

SEQ ID NO: 6371 - RNA, 21 nt, Homo sapiens
cgagggugucgggagggccau

SEQ ID NO: 6372 - RNA, 21 nt, Homo sapiens
gagggugucgggagggccauc

SEQ ID NO: 6373 - RNA, 21 nt, Homo sapiens
agggugucgggagggccaucg

SEQ ID NO: 6374 - RNA, 21 nt, Homo sapiens
gggugucgggagggccaucgc

SEQ ID NO: 6375 - RNA, 21 nt, Homo sapiens
ggugucgggagggccaucgcg

SEQ ID NO: 6376 - RNA, 21 nt, Homo sapiens
gugucgggagggccaucgcgg

SEQ ID NO: 6377 - RNA, 21 nt, Homo sapiens
ugucgggagggccaucgcggu

SEQ ID NO: 6378 - RNA, 21 nt, Homo sapiens
gucgggagggccaucgcggug

SEQ ID NO: 6379 - RNA, 21 nt, Homo sapiens
ucgggagggccaucgcgguga

SEQ ID NO: 6380 - RNA, 21 nt, Homo sapiens
cgggagggccaucgcggugag

SEQ ID NO: 6381 - RNA, 21 nt, Homo sapiens
gggagggccaucgcggugagc

SEQ ID NO: 6382 - RNA, 21 nt, Homo sapiens
ggagggccaucgcggugagcc

SEQ ID NO: 6383 - RNA, 21 nt, Homo sapiens
gagggccaucgcggugagccc

SEQ ID NO: 6384 - RNA, 21 nt, Homo sapiens
agggccaucgcggugagcccc

SEQ ID NO: 6385 - RNA, 21 nt, Homo sapiens
gggccaucgcggugagccccg

SEQ ID NO: 6386 - RNA, 21 nt, Homo sapiens
ggccaucgcggugagccccgg

SEQ ID NO: 6387 - RNA, 21 nt, Homo sapiens
gccaucgcggugagccccggc

SEQ ID NO: 6388 - RNA, 21 nt, Homo sapiens
ccaucgcggugagccccggcc

SEQ ID NO: 6389 - RNA, 21 nt, Homo sapiens
caucgcggugagccccggccg

SEQ ID NO: 6390 - RNA, 21 nt, Homo sapiens
aucgcggugagccccggccgg

SEQ ID NO: 6391 - RNA, 21 nt, Homo sapiens
ucgcggugagccccggccgga

SEQ ID NO: 6392 - RNA, 21 nt, Homo sapiens
cgcggugagccccggccggaa

SEQ ID NO: 6393 - RNA, 21 nt, Homo sapiens
gcggugagccccggccggaau

SEQ ID NO: 6394 - RNA, 21 nt, Homo sapiens
cggugagccccggccggaauu

SEQ ID NO: 6395 - RNA, 21 nt, Homo sapiens
ggugagccccggccggaauuu

SEQ ID NO: 6396 - RNA, 21 nt, Homo sapiens
gugagccccggccggaauuuc

SEQ ID NO: 6397 - RNA, 21 nt, Homo sapiens
ugagccccggccggaauuuca

SEQ ID NO: 6398 - RNA, 21 nt, Homo sapiens
gagccccggccggaauuucac

SEQ ID NO: 6399 - RNA, 21 nt, Homo sapiens
agccccggccggaauuucacg

SEQ ID NO: 6400 - RNA, 21 nt, Homo sapiens
gccccggccggaauuucacgg

SEQ ID NO: 6401 - RNA, 21 nt, Homo sapiens
ccccggccggaauuucacgga

SEQ ID NO: 6402 - RNA, 21 nt, Homo sapiens
cccggccggaauuucacggac

SEQ ID NO: 6403 - RNA, 21 nt, Homo sapiens
ccggccggaauuucacggacg

SEQ ID NO: 6404 - RNA, 21 nt, Homo sapiens
cggccggaauuucacggacgg

SEQ ID NO: 6405 - RNA, 21 nt, Homo sapiens
ggccggaauuucacggacgga

SEQ ID NO: 6406 - RNA, 21 nt, Homo sapiens
gccggaauuucacggacggac

SEQ ID NO: 6407 - RNA, 21 nt, Homo sapiens
ccggaauuucacggacggacg

SEQ ID NO: 6408 - RNA, 21 nt, Homo sapiens
cggaauuucacggacggacgc

SEQ ID NO: 6409 - RNA, 21 nt, Homo sapiens
ggaauuucacggacggacgcg

SEQ ID NO: 6410 - RNA, 21 nt, Homo sapiens
gaauuucacggacggacgcgg

SEQ ID NO: 6411 - RNA, 21 nt, Homo sapiens
aauuucacggacggacgcggg

SEQ ID NO: 6412 - RNA, 21 nt, Homo sapiens
auuucacggacggacgcgggc

SEQ ID NO: 6413 - RNA, 21 nt, Homo sapiens
uuucacggacggacgcgggca

SEQ ID NO: 6414 - RNA, 21 nt, Homo sapiens
uucacggacggacgcgggcag

SEQ ID NO: 6415 - RNA, 21 nt, Homo sapiens
ucacggacggacgcgggcaga

SEQ ID NO: 6416 - RNA, 21 nt, Homo sapiens
cacggacggacgcgggcagag

SEQ ID NO: 6417 - RNA, 21 nt, Homo sapiens
acggacggacgcgggcagaga

SEQ ID NO: 6418 - RNA, 21 nt, Homo sapiens
cggacggacgcgggcagagag

SEQ ID NO: 6419 - RNA, 21 nt, Homo sapiens
ggacggacgcgggcagagaga

SEQ ID NO: 6420 - RNA, 21 nt, Homo sapiens
gacggacgcgggcagagagag

SEQ ID NO: 6421 - RNA, 21 nt, Homo sapiens
acggacgcgggcagagagagg

SEQ ID NO: 6422 - RNA, 21 nt, Homo sapiens
cggacgcgggcagagagaggc

SEQ ID NO: 6423 - RNA, 21 nt, Homo sapiens
ggacgcgggcagagagaggcc

SEQ ID NO: 6424 - RNA, 21 nt, Homo sapiens
gacgcgggcagagagaggccg

SEQ ID NO: 6425 - RNA, 21 nt, Homo sapiens
acgcgggcagagagaggccgg

SEQ ID NO: 6426 - RNA, 21 nt, Homo sapiens
cgcgggcagagagaggccggc

SEQ ID NO: 6427 - RNA, 21 nt, Homo sapiens
gcgggcagagagaggccggcg

SEQ ID NO: 6428 - RNA, 21 nt, Homo sapiens
cgggcagagagaggccggcgg

SEQ ID NO: 6429 - RNA, 21 nt, Homo sapiens
gggcagagagaggccggcggg

SEQ ID NO: 6430 - RNA, 21 nt, Homo sapiens
ggcagagagaggccggcgggc

SEQ ID NO: 6431 - RNA, 21 nt, Homo sapiens
gcagagagaggccggcgggcu

SEQ ID NO: 6432 - RNA, 21 nt, Homo sapiens
cagagagaggccggcgggcuc

SEQ ID NO: 6433 - RNA, 21 nt, Homo sapiens
agagagaggccggcgggcucc

SEQ ID NO: 6434 - RNA, 21 nt, Homo sapiens
gagagaggccggcgggcuccc

SEQ ID NO: 6435 - RNA, 21 nt, Homo sapiens
agagaggccggcgggcucccg

SEQ ID NO: 6436 - RNA, 21 nt, Homo sapiens
gagaggccggcgggcucccgu

SEQ ID NO: 6437 - RNA, 21 nt, Homo sapiens
agaggccggcgggcucccgug

SEQ ID NO: 6438 - RNA, 21 nt, Homo sapiens
gaggccggcgggcucccgugc

SEQ ID NO: 6439 - RNA, 21 nt, Homo sapiens
aggccggcgggcucccgugca

SEQ ID NO: 6440 - RNA, 21 nt, Homo sapiens
ggccggcgggcucccgugcac

SEQ ID NO: 6441 - RNA, 21 nt, Homo sapiens
gccggcgggcucccgugcacc

SEQ ID NO: 6442 - RNA, 21 nt, Homo sapiens
ccggcgggcucccgugcaccu

SEQ ID NO: 6443 - RNA, 21 nt, Homo sapiens
cggcgggcucccgugcaccuc

SEQ ID NO: 6444 - RNA, 21 nt, Homo sapiens
ggcgggcucccgugcaccuca

SEQ ID NO: 6445 - RNA, 21 nt, Homo sapiens
gcgggcucccgugcaccucag

SEQ ID NO: 6446 - RNA, 21 nt, Homo sapiens
cgggcucccgugcaccucagc

SEQ ID NO: 6447 - RNA, 21 nt, Homo sapiens
gggcucccgugcaccucagcc

SEQ ID NO: 6448 - RNA, 21 nt, Homo sapiens
ggcucccgugcaccucagccg

SEQ ID NO: 6449 - RNA, 21 nt, Homo sapiens
gcucccgugcaccucagccgg

SEQ ID NO: 6450 - RNA, 21 nt, Homo sapiens
cucccgugcaccucagccgga

SEQ ID NO: 6451 - RNA, 21 nt, Homo sapiens
ucccgugcaccucagccggac

SEQ ID NO: 6452 - RNA, 21 nt, Homo sapiens
cccgugcaccucagccggacu

SEQ ID NO: 6453 - RNA, 21 nt, Homo sapiens
ccgugcaccucagccggacug

SEQ ID NO: 6454 - RNA, 21 nt, Homo sapiens
cgugcaccucagccggacugu

SEQ ID NO: 6455 - RNA, 21 nt, Homo sapiens
gugcaccucagccggacugug

SEQ ID NO: 6456 - RNA, 21 nt, Homo sapiens
ugcaccucagccggacugugc

SEQ ID NO: 6457 - RNA, 21 nt, Homo sapiens
gcaccucagccggacugugca

SEQ ID NO: 6458 - RNA, 21 nt, Homo sapiens
caccucagccggacugugcac

SEQ ID NO: 6459 - RNA, 21 nt, Homo sapiens
accucagccggacugugcacu

SEQ ID NO: 6460 - RNA, 21 nt, Homo sapiens
ccucagccggacugugcacug

SEQ ID NO: 6461 - RNA, 21 nt, Homo sapiens
cucagccggacugugcacugc

SEQ ID NO: 6462 - RNA, 21 nt, Homo sapiens
ucagccggacugugcacugcg

SEQ ID NO: 6463 - RNA, 21 nt, Homo sapiens
cagccggacugugcacugcgg

SEQ ID NO: 6464 - RNA, 21 nt, Homo sapiens
agccggacugugcacugcggc

SEQ ID NO: 6465 - RNA, 21 nt, Homo sapiens
gccggacugugcacugcggca

SEQ ID NO: 6466 - RNA, 21 nt, Homo sapiens
ccggacugugcacugcggcag

SEQ ID NO: 6467 - RNA, 21 nt, Homo sapiens
cggacugugcacugcggcagg

SEQ ID NO: 6468 - RNA, 21 nt, Homo sapiens
ggacugugcacugcggcaggu

SEQ ID NO: 6469 - RNA, 21 nt, Homo sapiens
gacugugcacugcggcaggug

SEQ ID NO: 6470 - RNA, 21 nt, Homo sapiens
acugugcacugcggcaggugc

SEQ ID NO: 6471 - RNA, 21 nt, Homo sapiens
cugugcacugcggcaggugca

SEQ ID NO: 6472 - RNA, 21 nt, Homo sapiens
ugugcacugcggcaggugcag

SEQ ID NO: 6473 - RNA, 21 nt, Homo sapiens
gugcacugcggcaggugcagc

SEQ ID NO: 6474 - RNA, 21 nt, Homo sapiens
ugcacugcggcaggugcagcc

SEQ ID NO: 6475 - RNA, 21 nt, Homo sapiens
gcacugcggcaggugcagcca

SEQ ID NO: 6476 - RNA, 21 nt, Homo sapiens
cacugcggcaggugcagccag

SEQ ID NO: 6477 - RNA, 21 nt, Homo sapiens
acugcggcaggugcagccagg

SEQ ID NO: 6478 - RNA, 21 nt, Homo sapiens
cugcggcaggugcagccagga

SEQ ID NO: 6479 - RNA, 21 nt, Homo sapiens
ugcggcaggugcagccaggag

SEQ ID NO: 6480 - RNA, 21 nt, Homo sapiens
gcggcaggugcagccaggagg

SEQ ID NO: 6481 - RNA, 21 nt, Homo sapiens
cggcaggugcagccaggaggc

SEQ ID NO: 6482 - RNA, 21 nt, Homo sapiens
ggcaggugcagccaggaggcc

SEQ ID NO: 6483 - RNA, 21 nt, Homo sapiens
gcaggugcagccaggaggccu

SEQ ID NO: 6484 - RNA, 21 nt, Homo sapiens
caggugcagccaggaggccug

SEQ ID NO: 6485 - RNA, 21 nt, Homo sapiens
aggugcagccaggaggccugc

SEQ ID NO: 6486 - RNA, 21 nt, Homo sapiens
ggugcagccaggaggccugcc

SEQ ID NO: 6487 - RNA, 21 nt, Homo sapiens
gugcagccaggaggccugccc

SEQ ID NO: 6488 - RNA, 21 nt, Homo sapiens
ugcagccaggaggccugcccg

SEQ ID NO: 6489 - RNA, 21 nt, Homo sapiens
gcagccaggaggccugcccgg

SEQ ID NO: 6490 - RNA, 21 nt, Homo sapiens
cagccaggaggccugcccgga

SEQ ID NO: 6491 - RNA, 21 nt, Homo sapiens
agccaggaggccugcccggac

SEQ ID NO: 6492 - RNA, 21 nt, Homo sapiens
gccaggaggccugcccggaca

SEQ ID NO: 6493 - RNA, 21 nt, Homo sapiens
ccaggaggccugcccggacag

SEQ ID NO: 6494 - RNA, 21 nt, Homo sapiens
caggaggccugcccggacagc

SEQ ID NO: 6495 - RNA, 21 nt, Homo sapiens
aggaggccugcccggacagcc

SEQ ID NO: 6496 - RNA, 21 nt, Homo sapiens
ggaggccugcccggacagcca

SEQ ID NO: 6497 - RNA, 21 nt, Homo sapiens
gaggccugcccggacagccag

SEQ ID NO: 6498 - RNA, 21 nt, Homo sapiens
aggccugcccggacagccagc

SEQ ID NO: 6499 - RNA, 21 nt, Homo sapiens
ggccugcccggacagccagcc

SEQ ID NO: 6500 - RNA, 21 nt, Homo sapiens
gccugcccggacagccagcca

SEQ ID NO: 6501 - RNA, 21 nt, Homo sapiens
ccugcccggacagccagccag

SEQ ID NO: 6502 - RNA, 21 nt, Homo sapiens
cugcccggacagccagccagc

SEQ ID NO: 6503 - RNA, 21 nt, Homo sapiens
ugcccggacagccagccagcc

SEQ ID NO: 6504 - RNA, 21 nt, Homo sapiens
gcccggacagccagccagcca

SEQ ID NO: 6505 - RNA, 21 nt, Homo sapiens
cccggacagccagccagccag

SEQ ID NO: 6506 - RNA, 21 nt, Homo sapiens
ccggacagccagccagccagc

SEQ ID NO: 6507 - RNA, 21 nt, Homo sapiens
cggacagccagccagccagcc

SEQ ID NO: 6508 - RNA, 21 nt, Homo sapiens
ggacagccagccagccagcca

SEQ ID NO: 6509 - RNA, 21 nt, Homo sapiens
gacagccagccagccagccag

SEQ ID NO: 6510 - RNA, 21 nt, Homo sapiens
acagccagccagccagccagc

SEQ ID NO: 6511 - RNA, 21 nt, Homo sapiens
cagccagccagccagccagcc

SEQ ID NO: 6512 - RNA, 21 nt, Homo sapiens
agccagccagccagccagccg

SEQ ID NO: 6513 - RNA, 21 nt, Homo sapiens
gccagccagccagccagccgc

SEQ ID NO: 6514 - RNA, 21 nt, Homo sapiens
ccagccagccagccagccgcc

SEQ ID NO: 6515 - RNA, 21 nt, Homo sapiens
cagccagccagccagccgccc

SEQ ID NO: 6516 - RNA, 21 nt, Homo sapiens
agccagccagccagccgcccu

SEQ ID NO: 6517 - RNA, 21 nt, Homo sapiens
gccagccagccagccgcccuu

SEQ ID NO: 6518 - RNA, 21 nt, Homo sapiens
ccagccagccagccgcccuug

SEQ ID NO: 6519 - RNA, 21 nt, Homo sapiens
cagccagccagccgcccuugu

SEQ ID NO: 6520 - RNA, 21 nt, Homo sapiens
agccagccagccgcccuugua

SEQ ID NO: 6521 - RNA, 21 nt, Homo sapiens
gccagccagccgcccuuguaa

SEQ ID NO: 6522 - RNA, 21 nt, Homo sapiens
ccagccagccgcccuuguaaa

SEQ ID NO: 6523 - RNA, 21 nt, Homo sapiens
cagccagccgcccuuguaaag

SEQ ID NO: 6524 - RNA, 21 nt, Homo sapiens
agccagccgcccuuguaaagg

SEQ ID NO: 6525 - RNA, 21 nt, Homo sapiens
gccagccgcccuuguaaaggc

SEQ ID NO: 6526 - RNA, 21 nt, Homo sapiens
ccagccgcccuuguaaaggcc

SEQ ID NO: 6527 - RNA, 21 nt, Homo sapiens
cagccgcccuuguaaaggccc

SEQ ID NO: 6528 - RNA, 21 nt, Homo sapiens
agccgcccuuguaaaggccca

SEQ ID NO: 6529 - RNA, 21 nt, Homo sapiens
gccgcccuuguaaaggcccac

SEQ ID NO: 6530 - RNA, 21 nt, Homo sapiens
ccgcccuuguaaaggcccaca

SEQ ID NO: 6531 - RNA, 21 nt, Homo sapiens
cgcccuuguaaaggcccacag

SEQ ID NO: 6532 - RNA, 21 nt, Homo sapiens
gcccuuguaaaggcccacagg

SEQ ID NO: 6533 - RNA, 21 nt, Homo sapiens
cccuuguaaaggcccacaggc

SEQ ID NO: 6534 - RNA, 21 nt, Homo sapiens
ccuuguaaaggcccacaggca

SEQ ID NO: 6535 - RNA, 21 nt, Homo sapiens
cuuguaaaggcccacaggcag

SEQ ID NO: 6536 - RNA, 21 nt, Homo sapiens
uuguaaaggcccacaggcagg

SEQ ID NO: 6537 - RNA, 21 nt, Homo sapiens
uguaaaggcccacaggcaggc

SEQ ID NO: 6538 - RNA, 21 nt, Homo sapiens
guaaaggcccacaggcaggca

SEQ ID NO: 6539 - RNA, 21 nt, Homo sapiens
uaaaggcccacaggcaggcag

SEQ ID NO: 6540 - RNA, 21 nt, Homo sapiens
aaaggcccacaggcaggcagg

SEQ ID NO: 6541 - RNA, 21 nt, Homo sapiens
aaggcccacaggcaggcaggc

SEQ ID NO: 6542 - RNA, 21 nt, Homo sapiens
aggcccacaggcaggcaggcu

SEQ ID NO: 6543 - RNA, 21 nt, Homo sapiens
ggcccacaggcaggcaggcuc

SEQ ID NO: 6544 - RNA, 21 nt, Homo sapiens
gcccacaggcaggcaggcucc

SEQ ID NO: 6545 - RNA, 21 nt, Homo sapiens
cccacaggcaggcaggcucca

SEQ ID NO: 6546 - RNA, 21 nt, Homo sapiens
ccacaggcaggcaggcuccac

SEQ ID NO: 6547 - RNA, 21 nt, Homo sapiens
cacaggcaggcaggcuccacc

SEQ ID NO: 6548 - RNA, 21 nt, Homo sapiens
acaggcaggcaggcuccaccc

SEQ ID NO: 6549 - RNA, 21 nt, Homo sapiens
caggcaggcaggcuccacccc

SEQ ID NO: 6550 - RNA, 21 nt, Homo sapiens
aggcaggcaggcuccaccccu

SEQ ID NO: 6551 - RNA, 21 nt, Homo sapiens
ggcaggcaggcuccaccccuu

SEQ ID NO: 6552 - RNA, 21 nt, Homo sapiens
gcaggcaggcuccaccccuuc

SEQ ID NO: 6553 - RNA, 21 nt, Homo sapiens
caggcaggcuccaccccuuca

SEQ ID NO: 6554 - RNA, 21 nt, Homo sapiens
aggcaggcuccaccccuucau

SEQ ID NO: 6555 - RNA, 22 nt, Homo sapiens
gagauguaacucuaauccaggu

SEQ ID NO: 6556 - RNA, 22 nt, Homo sapiens
agauguaacucuaauccagguu

SEQ ID NO: 6557 - RNA, 22 nt, Homo sapiens
gauguaacucuaauccagguuu

SEQ ID NO: 6558 - RNA, 22 nt, Homo sapiens
auguaacucuaauccagguuug

SEQ ID NO: 6559 - RNA, 22 nt, Homo sapiens
uguaacucuaauccagguuugc

SEQ ID NO: 6560 - RNA, 22 nt, Homo sapiens
guaacucuaauccagguuugcc

SEQ ID NO: 6561 - RNA, 22 nt, Homo sapiens
uaacucuaauccagguuugccu

SEQ ID NO: 6562 - RNA, 22 nt, Homo sapiens
aacucuaauccagguuugccua

SEQ ID NO: 6563 - RNA, 22 nt, Homo sapiens
acucuaauccagguuugccuag

SEQ ID NO: 6564 - RNA, 22 nt, Homo sapiens
cucuaauccagguuugccuaga

SEQ ID NO: 6565 - RNA, 22 nt, Homo sapiens
ucuaauccagguuugccuagac

SEQ ID NO: 6566 - RNA, 22 nt, Homo sapiens
cuaauccagguuugccuagaca

SEQ ID NO: 6567 - RNA, 22 nt, Homo sapiens
uaauccagguuugccuagacag

SEQ ID NO: 6568 - RNA, 22 nt, Homo sapiens
aauccagguuugccuagacagc

SEQ ID NO: 6569 - RNA, 22 nt, Homo sapiens
auccagguuugccuagacagcg

SEQ ID NO: 6570 - RNA, 22 nt, Homo sapiens
uccagguuugccuagacagcgu

SEQ ID NO: 6571 - RNA, 22 nt, Homo sapiens
ccagguuugccuagacagcguc

SEQ ID NO: 6572 - RNA, 22 nt, Homo sapiens
cagguuugccuagacagcgucg

SEQ ID NO: 6573 - RNA, 22 nt, Homo sapiens
agguuugccuagacagcgucgg

SEQ ID NO: 6574 - RNA, 22 nt, Homo sapiens
gguuugccuagacagcgucgga

SEQ ID NO: 6575 - RNA, 22 nt, Homo sapiens
guuugccuagacagcgucggaa

SEQ ID NO: 6576 - RNA, 22 nt, Homo sapiens
uuugccuagacagcgucggaag

SEQ ID NO: 6577 - RNA, 22 nt, Homo sapiens
uugccuagacagcgucggaagg

SEQ ID NO: 6578 - RNA, 22 nt, Homo sapiens
ugccuagacagcgucggaaggu

SEQ ID NO: 6579 - RNA, 22 nt, Homo sapiens
gccuagacagcgucggaaggug

SEQ ID NO: 6580 - RNA, 22 nt, Homo sapiens
ccuagacagcgucggaaggugg

SEQ ID NO: 6581 - RNA, 22 nt, Homo sapiens
cuagacagcgucggaagguggg

SEQ ID NO: 6582 - RNA, 22 nt, Homo sapiens
uagacagcgucggaaggugggg

SEQ ID NO: 6583 - RNA, 22 nt, Homo sapiens
agacagcgucggaagguggggg

SEQ ID NO: 6584 - RNA, 22 nt, Homo sapiens
gacagcgucggaaggugggggg

SEQ ID NO: 6585 - RNA, 22 nt, Homo sapiens
acagcgucggaaggugggggga

SEQ ID NO: 6586 - RNA, 22 nt, Homo sapiens
cagcgucggaagguggggggag

SEQ ID NO: 6587 - RNA, 22 nt, Homo sapiens
agcgucggaagguggggggaga

SEQ ID NO: 6588 - RNA, 22 nt, Homo sapiens
gcgucggaagguggggggagac

SEQ ID NO: 6589 - RNA, 22 nt, Homo sapiens
cgucggaagguggggggagaca

SEQ ID NO: 6590 - RNA, 22 nt, Homo sapiens
gucggaagguggggggagacau

SEQ ID NO: 6591 - RNA, 22 nt, Homo sapiens
ucggaagguggggggagacauu

SEQ ID NO: 6592 - RNA, 22 nt, Homo sapiens
cggaagguggggggagacauuc

SEQ ID NO: 6593 - RNA, 22 nt, Homo sapiens
ggaagguggggggagacauuca

SEQ ID NO: 6594 - RNA, 22 nt, Homo sapiens
gaagguggggggagacauucag

SEQ ID NO: 6595 - RNA, 22 nt, Homo sapiens
aagguggggggagacauucagc

SEQ ID NO: 6596 - RNA, 22 nt, Homo sapiens
agguggggggagacauucagcc

SEQ ID NO: 6597 - RNA, 22 nt, Homo sapiens
gguggggggagacauucagcca

SEQ ID NO: 6598 - RNA, 22 nt, Homo sapiens
guggggggagacauucagccag

SEQ ID NO: 6599 - RNA, 22 nt, Homo sapiens
uggggggagacauucagccaga

SEQ ID NO: 6600 - RNA, 22 nt, Homo sapiens
ggggggagacauucagccagaa

SEQ ID NO: 6601 - RNA, 22 nt, Homo sapiens
gggggagacauucagccagaau

SEQ ID NO: 6602 - RNA, 22 nt, Homo sapiens
ggggagacauucagccagaauu

SEQ ID NO: 6603 - RNA, 22 nt, Homo sapiens
gggagacauucagccagaauuu

SEQ ID NO: 6604 - RNA, 22 nt, Homo sapiens
ggagacauucagccagaauuuc

SEQ ID NO: 6605 - RNA, 22 nt, Homo sapiens
gagacauucagccagaauuuca

SEQ ID NO: 6606 - RNA, 22 nt, Homo sapiens
agacauucagccagaauuucac

SEQ ID NO: 6607 - RNA, 22 nt, Homo sapiens
gacauucagccagaauuucacg

SEQ ID NO: 6608 - RNA, 22 nt, Homo sapiens
acauucagccagaauuucacgg

SEQ ID NO: 6609 - RNA, 22 nt, Homo sapiens
cauucagccagaauuucacgga

SEQ ID NO: 6610 - RNA, 22 nt, Homo sapiens
auucagccagaauuucacggaa

SEQ ID NO: 6611 - RNA, 22 nt, Homo sapiens
uucagccagaauuucacggaag

SEQ ID NO: 6612 - RNA, 22 nt, Homo sapiens
ucagccagaauuucacggaaga

SEQ ID NO: 6613 - RNA, 22 nt, Homo sapiens
cagccagaauuucacggaagaa

SEQ ID NO: 6614 - RNA, 22 nt, Homo sapiens
agccagaauuucacggaagaac

SEQ ID NO: 6615 - RNA, 22 nt, Homo sapiens
gccagaauuucacggaagaaca

SEQ ID NO: 6616 - RNA, 22 nt, Homo sapiens
ccagaauuucacggaagaacaa

SEQ ID NO: 6617 - RNA, 22 nt, Homo sapiens
cagaauuucacggaagaacaag

SEQ ID NO: 6618 - RNA, 22 nt, Homo sapiens
agaauuucacggaagaacaagg

SEQ ID NO: 6619 - RNA, 22 nt, Homo sapiens
gaauuucacggaagaacaaggg

SEQ ID NO: 6620 - RNA, 22 nt, Homo sapiens
aauuucacggaagaacaagggc

SEQ ID NO: 6621 - RNA, 22 nt, Homo sapiens
auuucacggaagaacaagggca

SEQ ID NO: 6622 - RNA, 22 nt, Homo sapiens
uuucacggaagaacaagggcac

SEQ ID NO: 6623 - RNA, 22 nt, Homo sapiens
uucacggaagaacaagggcaca

SEQ ID NO: 6624 - RNA, 22 nt, Homo sapiens
ucacggaagaacaagggcacag

SEQ ID NO: 6625 - RNA, 22 nt, Homo sapiens
cacggaagaacaagggcacaga

SEQ ID NO: 6626 - RNA, 22 nt, Homo sapiens
acggaagaacaagggcacagag

SEQ ID NO: 6627 - RNA, 22 nt, Homo sapiens
cggaagaacaagggcacagaga

SEQ ID NO: 6628 - RNA, 22 nt, Homo sapiens
ggaagaacaagggcacagagag

SEQ ID NO: 6629 - RNA, 22 nt, Homo sapiens
gaagaacaagggcacagagagg

SEQ ID NO: 6630 - RNA, 22 nt, Homo sapiens
aagaacaagggcacagagaggc

SEQ ID NO: 6631 - RNA, 22 nt, Homo sapiens
agaacaagggcacagagaggcc

SEQ ID NO: 6632 - RNA, 22 nt, Homo sapiens
gaacaagggcacagagaggcca

SEQ ID NO: 6633 - RNA, 22 nt, Homo sapiens
aacaagggcacagagaggccag

SEQ ID NO: 6634 - RNA, 22 nt, Homo sapiens
acaagggcacagagaggccagc

SEQ ID NO: 6635 - RNA, 22 nt, Homo sapiens
caagggcacagagaggccagcg

SEQ ID NO: 6636 - RNA, 22 nt, Homo sapiens
aagggcacagagaggccagcga

SEQ ID NO: 6637 - RNA, 22 nt, Homo sapiens
agggcacagagaggccagcgag

SEQ ID NO: 6638 - RNA, 22 nt, Homo sapiens
gggcacagagaggccagcgagc

SEQ ID NO: 6639 - RNA, 22 nt, Homo sapiens
ggcacagagaggccagcgagcu

SEQ ID NO: 6640 - RNA, 22 nt, Homo sapiens
gcacagagaggccagcgagcuc

SEQ ID NO: 6641 - RNA, 22 nt, Homo sapiens
cacagagaggccagcgagcucc

SEQ ID NO: 6642 - RNA, 22 nt, Homo sapiens
acagagaggccagcgagcuccc

SEQ ID NO: 6643 - RNA, 22 nt, Homo sapiens
cagagaggccagcgagcucccu

SEQ ID NO: 6644 - RNA, 22 nt, Homo sapiens
agagaggccagcgagcucccuu

SEQ ID NO: 6645 - RNA, 22 nt, Homo sapiens
gagaggccagcgagcucccuug

SEQ ID NO: 6646 - RNA, 22 nt, Homo sapiens
agaggccagcgagcucccuugc

SEQ ID NO: 6647 - RNA, 22 nt, Homo sapiens
gaggccagcgagcucccuugca

SEQ ID NO: 6648 - RNA, 22 nt, Homo sapiens
aggccagcgagcucccuugcac

SEQ ID NO: 6649 - RNA, 22 nt, Homo sapiens
ggccagcgagcucccuugcacg

SEQ ID NO: 6650 - RNA, 22 nt, Homo sapiens
gccagcgagcucccuugcacgu

SEQ ID NO: 6651 - RNA, 22 nt, Homo sapiens
ccagcgagcucccuugcacguc

SEQ ID NO: 6652 - RNA, 22 nt, Homo sapiens
cagcgagcucccuugcacguca

SEQ ID NO: 6653 - RNA, 22 nt, Homo sapiens
agcgagcucccuugcacgucag

SEQ ID NO: 6654 - RNA, 22 nt, Homo sapiens
gcgagcucccuugcacgucagc

SEQ ID NO: 6655 - RNA, 22 nt, Homo sapiens
cgagcucccuugcacgucagcc

SEQ ID NO: 6656 - RNA, 22 nt, Homo sapiens
gagcucccuugcacgucagccg

SEQ ID NO: 6657 - RNA, 22 nt, Homo sapiens
agcucccuugcacgucagccgg

SEQ ID NO: 6658 - RNA, 22 nt, Homo sapiens
gcucccuugcacgucagccggg

SEQ ID NO: 6659 - RNA, 22 nt, Homo sapiens
cucccuugcacgucagccgggg

SEQ ID NO: 6660 - RNA, 22 nt, Homo sapiens
ucccuugcacgucagccggggu

SEQ ID NO: 6661 - RNA, 22 nt, Homo sapiens
cccuugcacgucagccggggug

SEQ ID NO: 6662 - RNA, 22 nt, Homo sapiens
ccuugcacgucagccggggugc

SEQ ID NO: 6663 - RNA, 22 nt, Homo sapiens
cuugcacgucagccggggugcg

SEQ ID NO: 6664 - RNA, 22 nt, Homo sapiens
uugcacgucagccggggugcgc

SEQ ID NO: 6665 - RNA, 22 nt, Homo sapiens
ugcacgucagccggggugcgca

SEQ ID NO: 6666 - RNA, 22 nt, Homo sapiens
gcacgucagccggggugcgcac

SEQ ID NO: 6667 - RNA, 22 nt, Homo sapiens
cacgucagccggggugcgcacu

SEQ ID NO: 6668 - RNA, 22 nt, Homo sapiens
acgucagccggggugcgcacug

SEQ ID NO: 6669 - RNA, 22 nt, Homo sapiens
cgucagccggggugcgcacugc

SEQ ID NO: 6670 - RNA, 22 nt, Homo sapiens
gucagccggggugcgcacugcg

SEQ ID NO: 6671 - RNA, 22 nt, Homo sapiens
ucagccggggugcgcacugcgc

SEQ ID NO: 6672 - RNA, 22 nt, Homo sapiens
cagccggggugcgcacugcgcg

SEQ ID NO: 6673 - RNA, 22 nt, Homo sapiens
agccggggugcgcacugcgcgc

SEQ ID NO: 6674 - RNA, 22 nt, Homo sapiens
gccggggugcgcacugcgcgca

SEQ ID NO: 6675 - RNA, 22 nt, Homo sapiens
ccggggugcgcacugcgcgcag

SEQ ID NO: 6676 - RNA, 22 nt, Homo sapiens
cggggugcgcacugcgcgcagg

SEQ ID NO: 6677 - RNA, 22 nt, Homo sapiens
ggggugcgcacugcgcgcaggu

SEQ ID NO: 6678 - RNA, 22 nt, Homo sapiens
gggugcgcacugcgcgcagguc

SEQ ID NO: 6679 - RNA, 22 nt, Homo sapiens
ggugcgcacugcgcgcaggucu

SEQ ID NO: 6680 - RNA, 22 nt, Homo sapiens
gugcgcacugcgcgcaggucua

SEQ ID NO: 6681 - RNA, 22 nt, Homo sapiens
ugcgcacugcgcgcaggucuag

SEQ ID NO: 6682 - RNA, 22 nt, Homo sapiens
gcgcacugcgcgcaggucuagc

SEQ ID NO: 6683 - RNA, 22 nt, Homo sapiens
cgcacugcgcgcaggucuagcc

SEQ ID NO: 6684 - RNA, 22 nt, Homo sapiens
gcacugcgcgcaggucuagcca

SEQ ID NO: 6685 - RNA, 22 nt, Homo sapiens
cacugcgcgcaggucuagccag

SEQ ID NO: 6686 - RNA, 22 nt, Homo sapiens
acugcgcgcaggucuagccagg

SEQ ID NO: 6687 - RNA, 22 nt, Homo sapiens
cugcgcgcaggucuagccagga

SEQ ID NO: 6688 - RNA, 22 nt, Homo sapiens
ugcgcgcaggucuagccaggaa

SEQ ID NO: 6689 - RNA, 22 nt, Homo sapiens
gcgcgcaggucuagccaggaag

SEQ ID NO: 6690 - RNA, 22 nt, Homo sapiens
cgcgcaggucuagccaggaagc

SEQ ID NO: 6691 - RNA, 22 nt, Homo sapiens
gcgcaggucuagccaggaagcg

SEQ ID NO: 6692 - RNA, 22 nt, Homo sapiens
cgcaggucuagccaggaagcgg

SEQ ID NO: 6693 - RNA, 22 nt, Homo sapiens
gcaggucuagccaggaagcggg

SEQ ID NO: 6694 - RNA, 22 nt, Homo sapiens
caggucuagccaggaagcgggc

SEQ ID NO: 6695 - RNA, 22 nt, Homo sapiens
aggucuagccaggaagcgggca

SEQ ID NO: 6696 - RNA, 22 nt, Homo sapiens
ggucuagccaggaagcgggcaa

SEQ ID NO: 6697 - RNA, 22 nt, Homo sapiens
gucuagccaggaagcgggcaaa

SEQ ID NO: 6698 - RNA, 22 nt, Homo sapiens
ucuagccaggaagcgggcaaag

SEQ ID NO: 6699 - RNA, 22 nt, Homo sapiens
cuagccaggaagcgggcaaaga

SEQ ID NO: 6700 - RNA, 22 nt, Homo sapiens
uagccaggaagcgggcaaagac

SEQ ID NO: 6701 - RNA, 22 nt, Homo sapiens
agccaggaagcgggcaaagaca

SEQ ID NO: 6702 - RNA, 22 nt, Homo sapiens
gccaggaagcgggcaaagacag

SEQ ID NO: 6703 - RNA, 22 nt, Homo sapiens
ccaggaagcgggcaaagacaga

SEQ ID NO: 6704 - RNA, 22 nt, Homo sapiens
caggaagcgggcaaagacagac

SEQ ID NO: 6705 - RNA, 22 nt, Homo sapiens
aggaagcgggcaaagacagaca

SEQ ID NO: 6706 - RNA, 22 nt, Homo sapiens
ggaagcgggcaaagacagacag

SEQ ID NO: 6707 - RNA, 22 nt, Homo sapiens
gaagcgggcaaagacagacaga

SEQ ID NO: 6708 - RNA, 22 nt, Homo sapiens
aagcgggcaaagacagacagag

SEQ ID NO: 6709 - RNA, 22 nt, Homo sapiens
agcgggcaaagacagacagagg

SEQ ID NO: 6710 - RNA, 22 nt, Homo sapiens
gcgggcaaagacagacagaggu

SEQ ID NO: 6711 - RNA, 22 nt, Homo sapiens
cgggcaaagacagacagaggua

SEQ ID NO: 6712 - RNA, 22 nt, Homo sapiens
gggcaaagacagacagagguau

SEQ ID NO: 6713 - RNA, 22 nt, Homo sapiens
ggcaaagacagacagagguaug

SEQ ID NO: 6714 - RNA, 22 nt, Homo sapiens
gcaaagacagacagagguaugc

SEQ ID NO: 6715 - RNA, 22 nt, Homo sapiens
caaagacagacagagguaugcu

SEQ ID NO: 6716 - RNA, 22 nt, Homo sapiens
aaagacagacagagguaugcuu

SEQ ID NO: 6717 - RNA, 22 nt, Homo sapiens
aagacagacagagguaugcuuu

SEQ ID NO: 6718 - RNA, 22 nt, Homo sapiens
agacagacagagguaugcuuuu

SEQ ID NO: 6719 - RNA, 22 nt, Homo sapiens
gacagacagagguaugcuuuug

SEQ ID NO: 6720 - RNA, 22 nt, Homo sapiens
acagacagagguaugcuuuuga

SEQ ID NO: 6721 - RNA, 22 nt, Homo sapiens
cagacagagguaugcuuuugac

SEQ ID NO: 6722 - RNA, 22 nt, Homo sapiens
agacagagguaugcuuuugacc

SEQ ID NO: 6723 - RNA, 22 nt, Homo sapiens
gacagagguaugcuuuugaccg

SEQ ID NO: 6724 - RNA, 22 nt, Homo sapiens
acagagguaugcuuuugaccgc

SEQ ID NO: 6725 - RNA, 22 nt, Homo sapiens
cagagguaugcuuuugaccgcc

SEQ ID NO: 6726 - RNA, 22 nt, Homo sapiens
agagguaugcuuuugaccgcca

SEQ ID NO: 6727 - RNA, 22 nt, Homo sapiens
gagguaugcuuuugaccgccag

SEQ ID NO: 6728 - RNA, 22 nt, Homo sapiens
agguaugcuuuugaccgccagg

SEQ ID NO: 6729 - RNA, 22 nt, Homo sapiens
gguaugcuuuugaccgccagga

SEQ ID NO: 6730 - RNA, 22 nt, Homo sapiens
guaugcuuuugaccgccaggag

SEQ ID NO: 6731 - RNA, 22 nt, Homo sapiens
uaugcuuuugaccgccaggagc

SEQ ID NO: 6732 - RNA, 22 nt, Homo sapiens
augcuuuugaccgccaggagcu

SEQ ID NO: 6733 - RNA, 22 nt, Homo sapiens
ugcuuuugaccgccaggagcuc

SEQ ID NO: 6734 - RNA, 22 nt, Homo sapiens
gcuuuugaccgccaggagcucc

SEQ ID NO: 6735 - RNA, 22 nt, Homo sapiens
cuuuugaccgccaggagcuccg

SEQ ID NO: 6736 - RNA, 22 nt, Homo sapiens
uuuugaccgccaggagcuccgc

SEQ ID NO: 6737 - RNA, 22 nt, Homo sapiens
uuugaccgccaggagcuccgcg

SEQ ID NO: 6738 - RNA, 22 nt, Homo sapiens
uugaccgccaggagcuccgcgc

SEQ ID NO: 6739 - RNA, 22 nt, Homo sapiens
ugaccgccaggagcuccgcgcu

SEQ ID NO: 6740 - RNA, 22 nt, Homo sapiens
gaccgccaggagcuccgcgcug

SEQ ID NO: 6741 - RNA, 22 nt, Homo sapiens
accgccaggagcuccgcgcugg

SEQ ID NO: 6742 - RNA, 22 nt, Homo sapiens
ccgccaggagcuccgcgcuggc

SEQ ID NO: 6743 - RNA, 22 nt, Homo sapiens
cgccaggagcuccgcgcuggca

SEQ ID NO: 6744 - RNA, 22 nt, Homo sapiens
gccaggagcuccgcgcuggcag

SEQ ID NO: 6745 - RNA, 22 nt, Homo sapiens
ccaggagcuccgcgcuggcagc

SEQ ID NO: 6746 - RNA, 22 nt, Homo sapiens
caggagcuccgcgcuggcagcu

SEQ ID NO: 6747 - RNA, 22 nt, Homo sapiens
aggagcuccgcgcuggcagcug

SEQ ID NO: 6748 - RNA, 22 nt, Homo sapiens
ggagcuccgcgcuggcagcugg

SEQ ID NO: 6749 - RNA, 22 nt, Homo sapiens
gagcuccgcgcuggcagcuggg

SEQ ID NO: 6750 - RNA, 22 nt, Homo sapiens
agcuccgcgcuggcagcuggga

SEQ ID NO: 6751 - RNA, 22 nt, Homo sapiens
gcuccgcgcuggcagcugggag

SEQ ID NO: 6752 - RNA, 22 nt, Homo sapiens
cuccgcgcuggcagcugggagg

SEQ ID NO: 6753 - RNA, 22 nt, Homo sapiens
uccgcgcuggcagcugggaggc

SEQ ID NO: 6754 - RNA, 22 nt, Homo sapiens
ccgcgcuggcagcugggaggcu

SEQ ID NO: 6755 - RNA, 22 nt, Homo sapiens
cgcgcuggcagcugggaggcug

SEQ ID NO: 6756 - RNA, 22 nt, Homo sapiens
gcgcuggcagcugggaggcugc

SEQ ID NO: 6757 - RNA, 22 nt, Homo sapiens
cgcuggcagcugggaggcugca

SEQ ID NO: 6758 - RNA, 22 nt, Homo sapiens
gcuggcagcugggaggcugcag

SEQ ID NO: 6759 - RNA, 22 nt, Homo sapiens
cuggcagcugggaggcugcagg

SEQ ID NO: 6760 - RNA, 22 nt, Homo sapiens
uggcagcugggaggcugcaggg

SEQ ID NO: 6761 - RNA, 22 nt, Homo sapiens
ggcagcugggaggcugcagggg

SEQ ID NO: 6762 - RNA, 22 nt, Homo sapiens
gcagcugggaggcugcaggggc

SEQ ID NO: 6763 - RNA, 22 nt, Homo sapiens
cagcugggaggcugcaggggcc

SEQ ID NO: 6764 - RNA, 22 nt, Homo sapiens
agcugggaggcugcaggggccc

SEQ ID NO: 6765 - RNA, 22 nt, Homo sapiens
gcugggaggcugcaggggcccg

SEQ ID NO: 6766 - RNA, 22 nt, Homo sapiens
cugggaggcugcaggggcccgg

SEQ ID NO: 6767 - RNA, 22 nt, Homo sapiens
ugggaggcugcaggggcccggg

SEQ ID NO: 6768 - RNA, 22 nt, Homo sapiens
gggaggcugcaggggcccgggc

SEQ ID NO: 6769 - RNA, 22 nt, Homo sapiens
ggaggcugcaggggcccgggcg

SEQ ID NO: 6770 - RNA, 22 nt, Homo sapiens
gaggcugcaggggcccgggcgg

SEQ ID NO: 6771 - RNA, 22 nt, Homo sapiens
aggcugcaggggcccgggcggg

SEQ ID NO: 6772 - RNA, 22 nt, Homo sapiens
ggcugcaggggcccgggcgggc

SEQ ID NO: 6773 - RNA, 22 nt, Homo sapiens
gcugcaggggcccgggcgggcg

SEQ ID NO: 6774 - RNA, 22 nt, Homo sapiens
cugcaggggcccgggcgggcgg

SEQ ID NO: 6775 - RNA, 22 nt, Homo sapiens
ugcaggggcccgggcgggcggg

SEQ ID NO: 6776 - RNA, 22 nt, Homo sapiens
gcaggggcccgggcgggcgggc

SEQ ID NO: 6777 - RNA, 22 nt, Homo sapiens
caggggcccgggcgggcgggcg

SEQ ID NO: 6778 - RNA, 22 nt, Homo sapiens
aggggcccgggcgggcgggcga

SEQ ID NO: 6779 - RNA, 22 nt, Homo sapiens
ggggcccgggcgggcgggcgac

SEQ ID NO: 6780 - RNA, 22 nt, Homo sapiens
gggcccgggcgggcgggcgacg

SEQ ID NO: 6781 - RNA, 22 nt, Homo sapiens
ggcccgggcgggcgggcgacgg

SEQ ID NO: 6782 - RNA, 22 nt, Homo sapiens
gcccgggcgggcgggcgacggu

SEQ ID NO: 6783 - RNA, 22 nt, Homo sapiens
cccgggcgggcgggcgacggug

SEQ ID NO: 6784 - RNA, 22 nt, Homo sapiens
ccgggcgggcgggcgacggugg

SEQ ID NO: 6785 - RNA, 22 nt, Homo sapiens
cgggcgggcgggcgacgguggc

SEQ ID NO: 6786 - RNA, 22 nt, Homo sapiens
gggcgggcgggcgacgguggcg

SEQ ID NO: 6787 - RNA, 22 nt, Homo sapiens
ggcgggcgggcgacgguggcgc

SEQ ID NO: 6788 - RNA, 22 nt, Homo sapiens
gcgggcgggcgacgguggcgcg

SEQ ID NO: 6789 - RNA, 22 nt, Homo sapiens
cgggcgggcgacgguggcgcgg

SEQ ID NO: 6790 - RNA, 22 nt, Homo sapiens
gggcgggcgacgguggcgcggg

SEQ ID NO: 6791 - RNA, 22 nt, Homo sapiens
ggcgggcgacgguggcgcgggg

SEQ ID NO: 6792 - RNA, 22 nt, Homo sapiens
gcgggcgacgguggcgcggggg

SEQ ID NO: 6793 - RNA, 22 nt, Homo sapiens
cgggcgacgguggcgcgggggc

SEQ ID NO: 6794 - RNA, 22 nt, Homo sapiens
gggcgacgguggcgcgggggca

SEQ ID NO: 6795 - RNA, 22 nt, Homo sapiens
ggcgacgguggcgcgggggcac

SEQ ID NO: 6796 - RNA, 22 nt, Homo sapiens
gcgacgguggcgcgggggcaca

SEQ ID NO: 6797 - RNA, 22 nt, Homo sapiens
cgacgguggcgcgggggcacac

SEQ ID NO: 6798 - RNA, 22 nt, Homo sapiens
gacgguggcgcgggggcacaca

SEQ ID NO: 6799 - RNA, 22 nt, Homo sapiens
acgguggcgcgggggcacacag

SEQ ID NO: 6800 - RNA, 22 nt, Homo sapiens
cgguggcgcgggggcacacagg

SEQ ID NO: 6801 - RNA, 22 nt, Homo sapiens
gguggcgcgggggcacacagga

SEQ ID NO: 6802 - RNA, 22 nt, Homo sapiens
guggcgcgggggcacacaggag

SEQ ID NO: 6803 - RNA, 22 nt, Homo sapiens
uggcgcgggggcacacaggagg

SEQ ID NO: 6804 - RNA, 22 nt, Homo sapiens
ggcgcgggggcacacaggaggc

SEQ ID NO: 6805 - RNA, 22 nt, Homo sapiens
gcgcgggggcacacaggaggcg

SEQ ID NO: 6806 - RNA, 22 nt, Homo sapiens
cgcgggggcacacaggaggcga

SEQ ID NO: 6807 - RNA, 22 nt, Homo sapiens
gcgggggcacacaggaggcgag

SEQ ID NO: 6808 - RNA, 22 nt, Homo sapiens
cgggggcacacaggaggcgagc

SEQ ID NO: 6809 - RNA, 22 nt, Homo sapiens
gggggcacacaggaggcgagcc

SEQ ID NO: 6810 - RNA, 22 nt, Homo sapiens
ggggcacacaggaggcgagccg

SEQ ID NO: 6811 - RNA, 22 nt, Homo sapiens
gggcacacaggaggcgagccgc

SEQ ID NO: 6812 - RNA, 22 nt, Homo sapiens
ggcacacaggaggcgagccgcc

SEQ ID NO: 6813 - RNA, 22 nt, Homo sapiens
gcacacaggaggcgagccgccg

SEQ ID NO: 6814 - RNA, 22 nt, Homo sapiens
cacacaggaggcgagccgccgg

SEQ ID NO: 6815 - RNA, 22 nt, Homo sapiens
acacaggaggcgagccgccgga

SEQ ID NO: 6816 - RNA, 22 nt, Homo sapiens
cacaggaggcgagccgccggag

SEQ ID NO: 6817 - RNA, 22 nt, Homo sapiens
acaggaggcgagccgccggagc

SEQ ID NO: 6818 - RNA, 22 nt, Homo sapiens
caggaggcgagccgccggagcg

SEQ ID NO: 6819 - RNA, 22 nt, Homo sapiens
aggaggcgagccgccggagcgg

SEQ ID NO: 6820 - RNA, 22 nt, Homo sapiens
ggaggcgagccgccggagcgga

SEQ ID NO: 6821 - RNA, 22 nt, Homo sapiens
gaggcgagccgccggagcggag

SEQ ID NO: 6822 - RNA, 22 nt, Homo sapiens
aggcgagccgccggagcggagu

SEQ ID NO: 6823 - RNA, 22 nt, Homo sapiens
ggcgagccgccggagcggaguc

SEQ ID NO: 6824 - RNA, 22 nt, Homo sapiens
gcgagccgccggagcggaguca

SEQ ID NO: 6825 - RNA, 22 nt, Homo sapiens
cgagccgccggagcggagucag

SEQ ID NO: 6826 - RNA, 22 nt, Homo sapiens
gagccgccggagcggagucagg

SEQ ID NO: 6827 - RNA, 22 nt, Homo sapiens
agccgccggagcggagucaggc

SEQ ID NO: 6828 - RNA, 22 nt, Homo sapiens
gccgccggagcggagucaggcc

SEQ ID NO: 6829 - RNA, 22 nt, Homo sapiens
ccgccggagcggagucaggccc

SEQ ID NO: 6830 - RNA, 22 nt, Homo sapiens
cgccggagcggagucaggcccg

SEQ ID NO: 6831 - RNA, 22 nt, Homo sapiens
gccggagcggagucaggcccgg

SEQ ID NO: 6832 - RNA, 22 nt, Homo sapiens
ccggagcggagucaggcccgga

SEQ ID NO: 6833 - RNA, 22 nt, Homo sapiens
cggagcggagucaggcccggac

SEQ ID NO: 6834 - RNA, 22 nt, Homo sapiens
ggagcggagucaggcccggacg

SEQ ID NO: 6835 - RNA, 22 nt, Homo sapiens
gagcggagucaggcccggacgc

SEQ ID NO: 6836 - RNA, 22 nt, Homo sapiens
agcggagucaggcccggacgcu

SEQ ID NO: 6837 - RNA, 22 nt, Homo sapiens
gcggagucaggcccggacgcug

SEQ ID NO: 6838 - RNA, 22 nt, Homo sapiens
cggagucaggcccggacgcugc

SEQ ID NO: 6839 - RNA, 22 nt, Homo sapiens
ggagucaggcccggacgcugcg

SEQ ID NO: 6840 - RNA, 22 nt, Homo sapiens
gagucaggcccggacgcugcgc

SEQ ID NO: 6841 - RNA, 22 nt, Homo sapiens
agucaggcccggacgcugcgcg

SEQ ID NO: 6842 - RNA, 22 nt, Homo sapiens
gucaggcccggacgcugcgcgg

SEQ ID NO: 6843 - RNA, 22 nt, Homo sapiens
ucaggcccggacgcugcgcggg

SEQ ID NO: 6844 - RNA, 22 nt, Homo sapiens
caggcccggacgcugcgcgggg

SEQ ID NO: 6845 - RNA, 22 nt, Homo sapiens
aggcccggacgcugcgcggggc

SEQ ID NO: 6846 - RNA, 22 nt, Homo sapiens
ggcccggacgcugcgcggggcc

SEQ ID NO: 6847 - RNA, 22 nt, Homo sapiens
gcccggacgcugcgcggggccc

SEQ ID NO: 6848 - RNA, 22 nt, Homo sapiens
cccggacgcugcgcggggcccg

SEQ ID NO: 6849 - RNA, 22 nt, Homo sapiens
ccggacgcugcgcggggcccgg

SEQ ID NO: 6850 - RNA, 22 nt, Homo sapiens
cggacgcugcgcggggcccggu

SEQ ID NO: 6851 - RNA, 22 nt, Homo sapiens
ggacgcugcgcggggcccggug

SEQ ID NO: 6852 - RNA, 22 nt, Homo sapiens
gacgcugcgcggggcccggugu

SEQ ID NO: 6853 - RNA, 22 nt, Homo sapiens
acgcugcgcggggcccgguguu

SEQ ID NO: 6854 - RNA, 22 nt, Homo sapiens
cgcugcgcggggcccgguguuu

SEQ ID NO: 6855 - RNA, 22 nt, Homo sapiens
gcugcgcggggcccgguguuuc

SEQ ID NO: 6856 - RNA, 22 nt, Homo sapiens
cugcgcggggcccgguguuucg

SEQ ID NO: 6857 - RNA, 22 nt, Homo sapiens
ugcgcggggcccgguguuucgc

SEQ ID NO: 6858 - RNA, 22 nt, Homo sapiens
gcgcggggcccgguguuucgcg

SEQ ID NO: 6859 - RNA, 22 nt, Homo sapiens
cgcggggcccgguguuucgcgg

SEQ ID NO: 6860 - RNA, 22 nt, Homo sapiens
gcggggcccgguguuucgcggg

SEQ ID NO: 6861 - RNA, 22 nt, Homo sapiens
cggggcccgguguuucgcggga

SEQ ID NO: 6862 - RNA, 22 nt, Homo sapiens
ggggcccgguguuucgcgggac

SEQ ID NO: 6863 - RNA, 22 nt, Homo sapiens
gggcccgguguuucgcgggacg

SEQ ID NO: 6864 - RNA, 22 nt, Homo sapiens
ggcccgguguuucgcgggacgg

SEQ ID NO: 6865 - RNA, 22 nt, Homo sapiens
gcccgguguuucgcgggacggg

SEQ ID NO: 6866 - RNA, 22 nt, Homo sapiens
cccgguguuucgcgggacgggg

SEQ ID NO: 6867 - RNA, 22 nt, Homo sapiens
ccgguguuucgcgggacggggg

SEQ ID NO: 6868 - RNA, 22 nt, Homo sapiens
cgguguuucgcgggacgggggu

SEQ ID NO: 6869 - RNA, 22 nt, Homo sapiens
gguguuucgcgggacggggguc

SEQ ID NO: 6870 - RNA, 22 nt, Homo sapiens
guguuucgcgggacgggggucu

SEQ ID NO: 6871 - RNA, 22 nt, Homo sapiens
uguuucgcgggacgggggucuc

SEQ ID NO: 6872 - RNA, 22 nt, Homo sapiens
guuucgcgggacgggggucucc

SEQ ID NO: 6873 - RNA, 22 nt, Homo sapiens
uuucgcgggacgggggucucca

SEQ ID NO: 6874 - RNA, 22 nt, Homo sapiens
uucgcgggacgggggucuccac

SEQ ID NO: 6875 - RNA, 22 nt, Homo sapiens
ucgcgggacgggggucuccacc

SEQ ID NO: 6876 - RNA, 22 nt, Homo sapiens
cgcgggacgggggucuccaccc

SEQ ID NO: 6877 - RNA, 22 nt, Homo sapiens
gcgggacgggggucuccaccca

SEQ ID NO: 6878 - RNA, 22 nt, Homo sapiens
cgggacgggggucuccacccag

SEQ ID NO: 6879 - RNA, 22 nt, Homo sapiens
gggacgggggucuccacccagc

SEQ ID NO: 6880 - RNA, 22 nt, Homo sapiens
ggacgggggucuccacccagcc

SEQ ID NO: 6881 - RNA, 22 nt, Homo sapiens
gacgggggucuccacccagccc

SEQ ID NO: 6882 - RNA, 22 nt, Homo sapiens
acgggggucuccacccagccca

SEQ ID NO: 6883 - RNA, 22 nt, Homo sapiens
cgggggucuccacccagcccag

SEQ ID NO: 6884 - RNA, 22 nt, Homo sapiens
gggggucuccacccagcccagg

SEQ ID NO: 6885 - RNA, 22 nt, Homo sapiens
ggggucuccacccagcccaggg

SEQ ID NO: 6886 - RNA, 22 nt, Homo sapiens
gggucuccacccagcccagggg

SEQ ID NO: 6887 - RNA, 22 nt, Homo sapiens
ggucuccacccagcccagggga

SEQ ID NO: 6888 - RNA, 22 nt, Homo sapiens
gucuccacccagcccaggggac

SEQ ID NO: 6889 - RNA, 22 nt, Homo sapiens
ucuccacccagcccaggggacg

SEQ ID NO: 6890 - RNA, 22 nt, Homo sapiens
cuccacccagcccaggggacga

SEQ ID NO: 6891 - RNA, 22 nt, Homo sapiens
uccacccagcccaggggacgac

SEQ ID NO: 6892 - RNA, 22 nt, Homo sapiens
ccacccagcccaggggacgacg

SEQ ID NO: 6893 - RNA, 22 nt, Homo sapiens
cacccagcccaggggacgacgc

SEQ ID NO: 6894 - RNA, 22 nt, Homo sapiens
acccagcccaggggacgacgcg

SEQ ID NO: 6895 - RNA, 22 nt, Homo sapiens
cccagcccaggggacgacgcgu

SEQ ID NO: 6896 - RNA, 22 nt, Homo sapiens
ccagcccaggggacgacgcguu

SEQ ID NO: 6897 - RNA, 22 nt, Homo sapiens
cagcccaggggacgacgcguuu

SEQ ID NO: 6898 - RNA, 22 nt, Homo sapiens
agcccaggggacgacgcguuuu

SEQ ID NO: 6899 - RNA, 22 nt, Homo sapiens
gcccaggggacgacgcguuuuc

SEQ ID NO: 6900 - RNA, 22 nt, Homo sapiens
cccaggggacgacgcguuuucc

SEQ ID NO: 6901 - RNA, 22 nt, Homo sapiens
ccaggggacgacgcguuuuccg

SEQ ID NO: 6902 - RNA, 22 nt, Homo sapiens
caggggacgacgcguuuuccgg

SEQ ID NO: 6903 - RNA, 22 nt, Homo sapiens
aggggacgacgcguuuuccggg

SEQ ID NO: 6904 - RNA, 22 nt, Homo sapiens
ggggacgacgcguuuuccgggg

SEQ ID NO: 6905 - RNA, 22 nt, Homo sapiens
gggacgacgcguuuuccggggg

SEQ ID NO: 6906 - RNA, 22 nt, Homo sapiens
ggacgacgcguuuuccgggggu

SEQ ID NO: 6907 - RNA, 22 nt, Homo sapiens
gacgacgcguuuuccgggggug

SEQ ID NO: 6908 - RNA, 22 nt, Homo sapiens
acgacgcguuuuccgggggugg

SEQ ID NO: 6909 - RNA, 22 nt, Homo sapiens
cgacgcguuuuccggggguggg

SEQ ID NO: 6910 - RNA, 22 nt, Homo sapiens
gacgcguuuuccgggggugggg

SEQ ID NO: 6911 - RNA, 22 nt, Homo sapiens
acgcguuuuccggggguggggg

SEQ ID NO: 6912 - RNA, 22 nt, Homo sapiens
cgcguuuuccgggggugggggg

SEQ ID NO: 6913 - RNA, 22 nt, Homo sapiens
gcguuuuccggggguggggggu

SEQ ID NO: 6914 - RNA, 22 nt, Homo sapiens
cguuuuccggggguggggggug

SEQ ID NO: 6915 - RNA, 22 nt, Homo sapiens
guuuuccggggguggggggugg

SEQ ID NO: 6916 - RNA, 22 nt, Homo sapiens
uuuuccgggggugggggguggg

SEQ ID NO: 6917 - RNA, 22 nt, Homo sapiens
uuuccggggguggggggugggg

SEQ ID NO: 6918 - RNA, 22 nt, Homo sapiens
uuccgggggugggggguggggg

SEQ ID NO: 6919 - RNA, 22 nt, Homo sapiens
uccggggguggggggugggggg

SEQ ID NO: 6920 - RNA, 22 nt, Homo sapiens
ccgggggugggggguggggggu

SEQ ID NO: 6921 - RNA, 22 nt, Homo sapiens
cgggggugggggguggggggug

SEQ ID NO: 6922 - RNA, 22 nt, Homo sapiens
gggggugggggguggggggugg

SEQ ID NO: 6923 - RNA, 22 nt, Homo sapiens
gggguggggggugggggguggg

SEQ ID NO: 6924 - RNA, 22 nt, Homo sapiens
gggugggggguggggggugggg

SEQ ID NO: 6925 - RNA, 22 nt, Homo sapiens
ggugggggguggggggugggga

SEQ ID NO: 6926 - RNA, 22 nt, Homo sapiens
guggggggugggggguggggag

SEQ ID NO: 6927 - RNA, 22 nt, Homo sapiens
uggggggugggggguggggagg

SEQ ID NO: 6928 - RNA, 22 nt, Homo sapiens
ggggggugggggguggggaggg

SEQ ID NO: 6929 - RNA, 22 nt, Homo sapiens
gggggugggggguggggagggg

SEQ ID NO: 6930 - RNA, 22 nt, Homo sapiens
ggggugggggguggggaggggg

SEQ ID NO: 6931 - RNA, 22 nt, Homo sapiens
gggugggggguggggagggggc

SEQ ID NO: 6932 - RNA, 22 nt, Homo sapiens
ggugggggguggggagggggcg

SEQ ID NO: 6933 - RNA, 22 nt, Homo sapiens
gugggggguggggagggggcgg

SEQ ID NO: 6934 - RNA, 22 nt, Homo sapiens
ugggggguggggagggggcggu

SEQ ID NO: 6935 - RNA, 22 nt, Homo sapiens
gggggguggggagggggcgguc

SEQ ID NO: 6936 - RNA, 22 nt, Homo sapiens
ggggguggggagggggcgguca

SEQ ID NO: 6937 - RNA, 22 nt, Homo sapiens
gggguggggagggggcggucag

SEQ ID NO: 6938 - RNA, 22 nt, Homo sapiens
ggguggggagggggcggucagg

SEQ ID NO: 6939 - RNA, 22 nt, Homo sapiens
gguggggagggggcggucaggc

SEQ ID NO: 6940 - RNA, 22 nt, Homo sapiens
guggggagggggcggucaggcg

SEQ ID NO: 6941 - RNA, 22 nt, Homo sapiens
uggggagggggcggucaggcgg

SEQ ID NO: 6942 - RNA, 22 nt, Homo sapiens
ggggagggggcggucaggcggc

SEQ ID NO: 6943 - RNA, 22 nt, Homo sapiens
gggagggggcggucaggcggcg

SEQ ID NO: 6944 - RNA, 22 nt, Homo sapiens
ggagggggcggucaggcggcgg

SEQ ID NO: 6945 - RNA, 22 nt, Homo sapiens
gagggggcggucaggcggcggg

SEQ ID NO: 6946 - RNA, 22 nt, Homo sapiens
agggggcggucaggcggcgggg

SEQ ID NO: 6947 - RNA, 22 nt, Homo sapiens
gggggcggucaggcggcggggu

SEQ ID NO: 6948 - RNA, 22 nt, Homo sapiens
ggggcggucaggcggcggggug

SEQ ID NO: 6949 - RNA, 22 nt, Homo sapiens
gggcggucaggcggcggggugg

SEQ ID NO: 6950 - RNA, 22 nt, Homo sapiens
ggcggucaggcggcgggguggg

SEQ ID NO: 6951 - RNA, 22 nt, Homo sapiens
gcggucaggcggcggggugggc

SEQ ID NO: 6952 - RNA, 22 nt, Homo sapiens
cggucaggcggcggggugggcu

SEQ ID NO: 6953 - RNA, 22 nt, Homo sapiens
ggucaggcggcggggugggcug

SEQ ID NO: 6954 - RNA, 22 nt, Homo sapiens
gucaggcggcggggugggcugg

SEQ ID NO: 6955 - RNA, 22 nt, Homo sapiens
ucaggcggcggggugggcuggu

SEQ ID NO: 6956 - RNA, 22 nt, Homo sapiens
caggcggcggggugggcuggug

SEQ ID NO: 6957 - RNA, 22 nt, Homo sapiens
aggcggcggggugggcuggugg

SEQ ID NO: 6958 - RNA, 22 nt, Homo sapiens
ggcggcggggugggcuggugga

SEQ ID NO: 6959 - RNA, 22 nt, Homo sapiens
gcggcggggugggcugguggag

SEQ ID NO: 6960 - RNA, 22 nt, Homo sapiens
cggcggggugggcugguggaga

SEQ ID NO: 6961 - RNA, 22 nt, Homo sapiens
ggcggggugggcugguggagag

SEQ ID NO: 6962 - RNA, 22 nt, Homo sapiens
gcggggugggcugguggagagg

SEQ ID NO: 6963 - RNA, 22 nt, Homo sapiens
cggggugggcugguggagaggc

SEQ ID NO: 6964 - RNA, 22 nt, Homo sapiens
ggggugggcugguggagaggca

SEQ ID NO: 6965 - RNA, 22 nt, Homo sapiens
gggugggcugguggagaggcag

SEQ ID NO: 6966 - RNA, 22 nt, Homo sapiens
ggugggcugguggagaggcagg

SEQ ID NO: 6967 - RNA, 22 nt, Homo sapiens
gugggcugguggagaggcagga

SEQ ID NO: 6968 - RNA, 22 nt, Homo sapiens
ugggcugguggagaggcaggag

SEQ ID NO: 6969 - RNA, 22 nt, Homo sapiens
gggcugguggagaggcaggaga

SEQ ID NO: 6970 - RNA, 22 nt, Homo sapiens
ggcugguggagaggcaggagag

SEQ ID NO: 6971 - RNA, 22 nt, Homo sapiens
gcugguggagaggcaggagagc

SEQ ID NO: 6972 - RNA, 22 nt, Homo sapiens
cugguggagaggcaggagagcu

SEQ ID NO: 6973 - RNA, 22 nt, Homo sapiens
ugguggagaggcaggagagcuc

SEQ ID NO: 6974 - RNA, 22 nt, Homo sapiens
gguggagaggcaggagagcucu

SEQ ID NO: 6975 - RNA, 22 nt, Homo sapiens
guggagaggcaggagagcucug

SEQ ID NO: 6976 - RNA, 22 nt, Homo sapiens
uggagaggcaggagagcucugc

SEQ ID NO: 6977 - RNA, 22 nt, Homo sapiens
ggagaggcaggagagcucugcc

SEQ ID NO: 6978 - RNA, 22 nt, Homo sapiens
gagaggcaggagagcucugccc

SEQ ID NO: 6979 - RNA, 22 nt, Homo sapiens
agaggcaggagagcucugcccg

SEQ ID NO: 6980 - RNA, 22 nt, Homo sapiens
gaggcaggagagcucugcccgg

SEQ ID NO: 6981 - RNA, 22 nt, Homo sapiens
aggcaggagagcucugcccggg

SEQ ID NO: 6982 - RNA, 22 nt, Homo sapiens
ggcaggagagcucugcccgggc

SEQ ID NO: 6983 - RNA, 22 nt, Homo sapiens
gcaggagagcucugcccgggcu

SEQ ID NO: 6984 - RNA, 22 nt, Homo sapiens
caggagagcucugcccgggcug

SEQ ID NO: 6985 - RNA, 22 nt, Homo sapiens
aggagagcucugcccgggcugc

SEQ ID NO: 6986 - RNA, 22 nt, Homo sapiens
ggagagcucugcccgggcugcu

SEQ ID NO: 6987 - RNA, 22 nt, Homo sapiens
gagagcucugcccgggcugcuc

SEQ ID NO: 6988 - RNA, 22 nt, Homo sapiens
agagcucugcccgggcugcucc

SEQ ID NO: 6989 - RNA, 22 nt, Homo sapiens
gagcucugcccgggcugcuccc

SEQ ID NO: 6990 - RNA, 22 nt, Homo sapiens
agcucugcccgggcugcuccca

SEQ ID NO: 6991 - RNA, 22 nt, Homo sapiens
gcucugcccgggcugcucccac

SEQ ID NO: 6992 - RNA, 22 nt, Homo sapiens
cucugcccgggcugcucccaca

SEQ ID NO: 6993 - RNA, 22 nt, Homo sapiens
ucugcccgggcugcucccacag

SEQ ID NO: 6994 - RNA, 22 nt, Homo sapiens
cugcccgggcugcucccacagc

SEQ ID NO: 6995 - RNA, 22 nt, Homo sapiens
ugcccgggcugcucccacagcc

SEQ ID NO: 6996 - RNA, 22 nt, Homo sapiens
gcccgggcugcucccacagccc

SEQ ID NO: 6997 - RNA, 22 nt, Homo sapiens
cccgggcugcucccacagccca

SEQ ID NO: 6998 - RNA, 22 nt, Homo sapiens
ccgggcugcucccacagcccag

SEQ ID NO: 6999 - RNA, 22 nt, Homo sapiens
cgggcugcucccacagcccagg

SEQ ID NO: 7000 - RNA, 22 nt, Homo sapiens
gggcugcucccacagcccaggc

SEQ ID NO: 7001 - RNA, 22 nt, Homo sapiens
ggcugcucccacagcccaggcg

SEQ ID NO: 7002 - RNA, 22 nt, Homo sapiens
gcugcucccacagcccaggcgg

SEQ ID NO: 7003 - RNA, 22 nt, Homo sapiens
cugcucccacagcccaggcggc

SEQ ID NO: 7004 - RNA, 22 nt, Homo sapiens
ugcucccacagcccaggcggcu

SEQ ID NO: 7005 - RNA, 22 nt, Homo sapiens
gcucccacagcccaggcggcug

SEQ ID NO: 7006 - RNA, 22 nt, Homo sapiens
cucccacagcccaggcggcugc

SEQ ID NO: 7007 - RNA, 22 nt, Homo sapiens
ucccacagcccaggcggcugcc

SEQ ID NO: 7008 - RNA, 22 nt, Homo sapiens
cccacagcccaggcggcugccc

SEQ ID NO: 7009 - RNA, 22 nt, Homo sapiens
ccacagcccaggcggcugcccg

SEQ ID NO: 7010 - RNA, 22 nt, Homo sapiens
cacagcccaggcggcugcccgc

SEQ ID NO: 7011 - RNA, 22 nt, Homo sapiens
acagcccaggcggcugcccgca

SEQ ID NO: 7012 - RNA, 22 nt, Homo sapiens
cagcccaggcggcugcccgcaa

SEQ ID NO: 7013 - RNA, 22 nt, Homo sapiens
agcccaggcggcugcccgcaaa

SEQ ID NO: 7014 - RNA, 22 nt, Homo sapiens
gcccaggcggcugcccgcaaac

SEQ ID NO: 7015 - RNA, 22 nt, Homo sapiens
cccaggcggcugcccgcaaacc

SEQ ID NO: 7016 - RNA, 22 nt, Homo sapiens
ccaggcggcugcccgcaaaccc

SEQ ID NO: 7017 - RNA, 22 nt, Homo sapiens
caggcggcugcccgcaaacccg

SEQ ID NO: 7018 - RNA, 22 nt, Homo sapiens
aggcggcugcccgcaaacccgc

SEQ ID NO: 7019 - RNA, 22 nt, Homo sapiens
ggcggcugcccgcaaacccgcg

SEQ ID NO: 7020 - RNA, 22 nt, Homo sapiens
gcggcugcccgcaaacccgcgc

SEQ ID NO: 7021 - RNA, 22 nt, Homo sapiens
cggcugcccgcaaacccgcgcg

SEQ ID NO: 7022 - RNA, 22 nt, Homo sapiens
ggcugcccgcaaacccgcgcgu

SEQ ID NO: 7023 - RNA, 22 nt, Homo sapiens
gcugcccgcaaacccgcgcgug

SEQ ID NO: 7024 - RNA, 22 nt, Homo sapiens
cugcccgcaaacccgcgcgugc

SEQ ID NO: 7025 - RNA, 22 nt, Homo sapiens
ugcccgcaaacccgcgcgugcg

SEQ ID NO: 7026 - RNA, 22 nt, Homo sapiens
gcccgcaaacccgcgcgugcgc

SEQ ID NO: 7027 - RNA, 22 nt, Homo sapiens
cccgcaaacccgcgcgugcgca

SEQ ID NO: 7028 - RNA, 22 nt, Homo sapiens
ccgcaaacccgcgcgugcgcag

SEQ ID NO: 7029 - RNA, 22 nt, Homo sapiens
cgcaaacccgcgcgugcgcagu

SEQ ID NO: 7030 - RNA, 22 nt, Homo sapiens
gcaaacccgcgcgugcgcagua

SEQ ID NO: 7031 - RNA, 22 nt, Homo sapiens
caaacccgcgcgugcgcaguag

SEQ ID NO: 7032 - RNA, 22 nt, Homo sapiens
aaacccgcgcgugcgcaguagg

SEQ ID NO: 7033 - RNA, 22 nt, Homo sapiens
aacccgcgcgugcgcaguaggc

SEQ ID NO: 7034 - RNA, 22 nt, Homo sapiens
acccgcgcgugcgcaguaggcg

SEQ ID NO: 7035 - RNA, 22 nt, Homo sapiens
cccgcgcgugcgcaguaggcgg

SEQ ID NO: 7036 - RNA, 22 nt, Homo sapiens
ccgcgcgugcgcaguaggcggc

SEQ ID NO: 7037 - RNA, 22 nt, Homo sapiens
cgcgcgugcgcaguaggcggcc

SEQ ID NO: 7038 - RNA, 22 nt, Homo sapiens
gcgcgugcgcaguaggcggccc

SEQ ID NO: 7039 - RNA, 22 nt, Homo sapiens
cgcgugcgcaguaggcggccca

SEQ ID NO: 7040 - RNA, 22 nt, Homo sapiens
gcgugcgcaguaggcggcccac

SEQ ID NO: 7041 - RNA, 22 nt, Homo sapiens
cgugcgcaguaggcggcccacc

SEQ ID NO: 7042 - RNA, 22 nt, Homo sapiens
gugcgcaguaggcggcccaccu

SEQ ID NO: 7043 - RNA, 22 nt, Homo sapiens
ugcgcaguaggcggcccaccug

SEQ ID NO: 7044 - RNA, 22 nt, Homo sapiens
gcgcaguaggcggcccaccugc

SEQ ID NO: 7045 - RNA, 22 nt, Homo sapiens
cgcaguaggcggcccaccugcu

SEQ ID NO: 7046 - RNA, 22 nt, Homo sapiens
gcaguaggcggcccaccugcug

SEQ ID NO: 7047 - RNA, 22 nt, Homo sapiens
caguaggcggcccaccugcugg

SEQ ID NO: 7048 - RNA, 22 nt, Homo sapiens
aguaggcggcccaccugcuggu

SEQ ID NO: 7049 - RNA, 22 nt, Homo sapiens
guaggcggcccaccugcuggua

SEQ ID NO: 7050 - RNA, 22 nt, Homo sapiens
uaggcggcccaccugcugguac

SEQ ID NO: 7051 - RNA, 22 nt, Homo sapiens
aggcggcccaccugcugguacc

SEQ ID NO: 7052 - RNA, 22 nt, Homo sapiens
ggcggcccaccugcugguaccu

SEQ ID NO: 7053 - RNA, 22 nt, Homo sapiens
gcggcccaccugcugguaccug

SEQ ID NO: 7054 - RNA, 22 nt, Homo sapiens
cggcccaccugcugguaccugg

SEQ ID NO: 7055 - RNA, 22 nt, Homo sapiens
ggcccaccugcugguaccuggg

SEQ ID NO: 7056 - RNA, 22 nt, Homo sapiens
gcccaccugcugguaccugggc

SEQ ID NO: 7057 - RNA, 22 nt, Homo sapiens
cccaccugcugguaccugggcc

SEQ ID NO: 7058 - RNA, 22 nt, Homo sapiens
ccaccugcugguaccugggccg

SEQ ID NO: 7059 - RNA, 22 nt, Homo sapiens
caccugcugguaccugggccgg

SEQ ID NO: 7060 - RNA, 22 nt, Homo sapiens
accugcugguaccugggccggc

SEQ ID NO: 7061 - RNA, 22 nt, Homo sapiens
ccugcugguaccugggccggcu

SEQ ID NO: 7062 - RNA, 22 nt, Homo sapiens
cugcugguaccugggccggcuc

SEQ ID NO: 7063 - RNA, 22 nt, Homo sapiens
ugcugguaccugggccggcucu

SEQ ID NO: 7064 - RNA, 22 nt, Homo sapiens
gcugguaccugggccggcucug

SEQ ID NO: 7065 - RNA, 22 nt, Homo sapiens
cugguaccugggccggcucugg

SEQ ID NO: 7066 - RNA, 22 nt, Homo sapiens
ugguaccugggccggcucuggg

SEQ ID NO: 7067 - RNA, 22 nt, Homo sapiens
gguaccugggccggcucuggga

SEQ ID NO: 7068 - RNA, 22 nt, Homo sapiens
guaccugggccggcucugggau

SEQ ID NO: 7069 - RNA, 22 nt, Homo sapiens
uaccugggccggcucugggauc

SEQ ID NO: 7070 - RNA, 22 nt, Homo sapiens
accugggccggcucugggaucc

SEQ ID NO: 7071 - RNA, 22 nt, Homo sapiens
ccugggccggcucugggauccc

SEQ ID NO: 7072 - RNA, 22 nt, Homo sapiens
cugggccggcucugggaucccc

SEQ ID NO: 7073 - RNA, 22 nt, Homo sapiens
ugggccggcucugggauccccg

SEQ ID NO: 7074 - RNA, 22 nt, Homo sapiens
gggccggcucugggauccccgg

SEQ ID NO: 7075 - RNA, 22 nt, Homo sapiens
ggccggcucugggauccccggg

SEQ ID NO: 7076 - RNA, 22 nt, Homo sapiens
gccggcucugggauccccggga

SEQ ID NO: 7077 - RNA, 22 nt, Homo sapiens
ccggcucugggauccccgggau

SEQ ID NO: 7078 - RNA, 22 nt, Homo sapiens
cggcucugggauccccgggaug

SEQ ID NO: 7079 - RNA, 22 nt, Homo sapiens
ggcucugggauccccgggaugc

SEQ ID NO: 7080 - RNA, 22 nt, Homo sapiens
gcucugggauccccgggaugcc

SEQ ID NO: 7081 - RNA, 22 nt, Homo sapiens
cucugggauccccgggaugccc

SEQ ID NO: 7082 - RNA, 22 nt, Homo sapiens
ucugggauccccgggaugccca

SEQ ID NO: 7083 - RNA, 22 nt, Homo sapiens
cugggauccccgggaugcccag

SEQ ID NO: 7084 - RNA, 22 nt, Homo sapiens
ugggauccccgggaugcccagg

SEQ ID NO: 7085 - RNA, 22 nt, Homo sapiens
gggauccccgggaugcccagga

SEQ ID NO: 7086 - RNA, 22 nt, Homo sapiens
ggauccccgggaugcccaggaa

SEQ ID NO: 7087 - RNA, 22 nt, Homo sapiens
gauccccgggaugcccaggaaa

SEQ ID NO: 7088 - RNA, 22 nt, Homo sapiens
auccccgggaugcccaggaaag

SEQ ID NO: 7089 - RNA, 22 nt, Homo sapiens
uccccgggaugcccaggaaaga

SEQ ID NO: 7090 - RNA, 22 nt, Homo sapiens
ccccgggaugcccaggaaagaa

SEQ ID NO: 7091 - RNA, 22 nt, Homo sapiens
cccgggaugcccaggaaagaau

SEQ ID NO: 7092 - RNA, 22 nt, Homo sapiens
ccgggaugcccaggaaagaaug

SEQ ID NO: 7093 - RNA, 22 nt, Homo sapiens
cgggaugcccaggaaagaaugg

SEQ ID NO: 7094 - RNA, 22 nt, Homo sapiens
gggaugcccaggaaagaauggc

SEQ ID NO: 7095 - RNA, 22 nt, Homo sapiens
ggaugcccaggaaagaauggca

SEQ ID NO: 7096 - RNA, 22 nt, Homo sapiens
gaugcccaggaaagaauggcag

SEQ ID NO: 7097 - RNA, 22 nt, Homo sapiens
augcccaggaaagaauggcagu

SEQ ID NO: 7098 - RNA, 22 nt, Homo sapiens
ugcccaggaaagaauggcaguu

SEQ ID NO: 7099 - RNA, 22 nt, Homo sapiens
gcccaggaaagaauggcaguuc

SEQ ID NO: 7100 - RNA, 22 nt, Homo sapiens
cccaggaaagaauggcaguucu

SEQ ID NO: 7101 - RNA, 22 nt, Homo sapiens
ccaggaaagaauggcaguucuc

SEQ ID NO: 7102 - RNA, 22 nt, Homo sapiens
caggaaagaauggcaguucucc

SEQ ID NO: 7103 - RNA, 22 nt, Homo sapiens
aggaaagaauggcaguucuccg

SEQ ID NO: 7104 - RNA, 22 nt, Homo sapiens
ggaaagaauggcaguucuccgc

SEQ ID NO: 7105 - RNA, 22 nt, Homo sapiens
gaaagaauggcaguucuccgcg

SEQ ID NO: 7106 - RNA, 22 nt, Homo sapiens
aaagaauggcaguucuccgcgg

SEQ ID NO: 7107 - RNA, 22 nt, Homo sapiens
aagaauggcaguucuccgcggu

SEQ ID NO: 7108 - RNA, 22 nt, Homo sapiens
agaauggcaguucuccgcggug

SEQ ID NO: 7109 - RNA, 22 nt, Homo sapiens
gaauggcaguucuccgcggugu

SEQ ID NO: 7110 - RNA, 22 nt, Homo sapiens
aauggcaguucuccgcggugug

SEQ ID NO: 7111 - RNA, 22 nt, Homo sapiens
auggcaguucuccgcggugugg

SEQ ID NO: 7112 - RNA, 22 nt, Homo sapiens
uggcaguucuccgcggugugga

SEQ ID NO: 7113 - RNA, 22 nt, Homo sapiens
ggcaguucuccgcgguguggag

SEQ ID NO: 7114 - RNA, 22 nt, Homo sapiens
gcaguucuccgcgguguggagu

SEQ ID NO: 7115 - RNA, 22 nt, Homo sapiens
caguucuccgcgguguggaguc

SEQ ID NO: 7116 - RNA, 22 nt, Homo sapiens
aguucuccgcgguguggagucu

SEQ ID NO: 7117 - RNA, 22 nt, Homo sapiens
guucuccgcgguguggagucuc

SEQ ID NO: 7118 - RNA, 22 nt, Homo sapiens
uucuccgcgguguggagucucu

SEQ ID NO: 7119 - RNA, 22 nt, Homo sapiens
ucuccgcgguguggagucucuc

SEQ ID NO: 7120 - RNA, 22 nt, Homo sapiens
cuccgcgguguggagucucuca

SEQ ID NO: 7121 - RNA, 22 nt, Homo sapiens
uccgcgguguggagucucucac

SEQ ID NO: 7122 - RNA, 22 nt, Homo sapiens
ccgcgguguggagucucucacc

SEQ ID NO: 7123 - RNA, 22 nt, Homo sapiens
cgcgguguggagucucucaccg

SEQ ID NO: 7124 - RNA, 22 nt, Homo sapiens
gcgguguggagucucucaccgg

SEQ ID NO: 7125 - RNA, 22 nt, Homo sapiens
cgguguggagucucucaccggg

SEQ ID NO: 7126 - RNA, 22 nt, Homo sapiens
gguguggagucucucaccgggc

SEQ ID NO: 7127 - RNA, 22 nt, Homo sapiens
guguggagucucucaccgggcc

SEQ ID NO: 7128 - RNA, 22 nt, Homo sapiens
uguggagucucucaccgggccu

SEQ ID NO: 7129 - RNA, 22 nt, Homo sapiens
guggagucucucaccgggccua

SEQ ID NO: 7130 - RNA, 22 nt, Homo sapiens
uggagucucucaccgggccuag

SEQ ID NO: 7131 - RNA, 22 nt, Homo sapiens
ggagucucucaccgggccuaga

SEQ ID NO: 7132 - RNA, 22 nt, Homo sapiens
gagucucucaccgggccuagac

SEQ ID NO: 7133 - RNA, 22 nt, Homo sapiens
agucucucaccgggccuagacc

SEQ ID NO: 7134 - RNA, 22 nt, Homo sapiens
gucucucaccgggccuagaccu

SEQ ID NO: 7135 - RNA, 22 nt, Homo sapiens
ucucucaccgggccuagaccua

SEQ ID NO: 7136 - RNA, 22 nt, Homo sapiens
cucucaccgggccuagaccuag

SEQ ID NO: 7137 - RNA, 22 nt, Homo sapiens
ucucaccgggccuagaccuaga

SEQ ID NO: 7138 - RNA, 22 nt, Homo sapiens
cucaccgggccuagaccuagaa

SEQ ID NO: 7139 - RNA, 22 nt, Homo sapiens
ucaccgggccuagaccuagaag

SEQ ID NO: 7140 - RNA, 22 nt, Homo sapiens
caccgggccuagaccuagaagg

SEQ ID NO: 7141 - RNA, 22 nt, Homo sapiens
accgggccuagaccuagaaggc

SEQ ID NO: 7142 - RNA, 22 nt, Homo sapiens
ccgggccuagaccuagaaggca

SEQ ID NO: 7143 - RNA, 22 nt, Homo sapiens
cgggccuagaccuagaaggcag

SEQ ID NO: 7144 - RNA, 22 nt, Homo sapiens
gggccuagaccuagaaggcagg

SEQ ID NO: 7145 - RNA, 22 nt, Homo sapiens
ggccuagaccuagaaggcagga

SEQ ID NO: 7146 - RNA, 22 nt, Homo sapiens
gccuagaccuagaaggcaggaa

SEQ ID NO: 7147 - RNA, 22 nt, Homo sapiens
ccuagaccuagaaggcaggaau

SEQ ID NO: 7148 - RNA, 22 nt, Homo sapiens
cuagaccuagaaggcaggaauc

SEQ ID NO: 7149 - RNA, 22 nt, Homo sapiens
uagaccuagaaggcaggaaucc

SEQ ID NO: 7150 - RNA, 22 nt, Homo sapiens
agaccuagaaggcaggaauccc

SEQ ID NO: 7151 - RNA, 22 nt, Homo sapiens
gaccuagaaggcaggaauccca

SEQ ID NO: 7152 - RNA, 22 nt, Homo sapiens
accuagaaggcaggaaucccag

SEQ ID NO: 7153 - RNA, 22 nt, Homo sapiens
ccuagaaggcaggaaucccagg

SEQ ID NO: 7154 - RNA, 22 nt, Homo sapiens
cuagaaggcaggaaucccaggc

SEQ ID NO: 7155 - RNA, 22 nt, Homo sapiens
uagaaggcaggaaucccaggcc

SEQ ID NO: 7156 - RNA, 22 nt, Homo sapiens
agaaggcaggaaucccaggccg

SEQ ID NO: 7157 - RNA, 22 nt, Homo sapiens
gaaggcaggaaucccaggccgg

SEQ ID NO: 7158 - RNA, 22 nt, Homo sapiens
aaggcaggaaucccaggccggu

SEQ ID NO: 7159 - RNA, 22 nt, Homo sapiens
aggcaggaaucccaggccgguc

SEQ ID NO: 7160 - RNA, 22 nt, Homo sapiens
ggcaggaaucccaggccgguca

SEQ ID NO: 7161 - RNA, 22 nt, Homo sapiens
gcaggaaucccaggccggucag

SEQ ID NO: 7162 - RNA, 22 nt, Homo sapiens
caggaaucccaggccggucagc

SEQ ID NO: 7163 - RNA, 22 nt, Homo sapiens
aggaaucccaggccggucagcc

SEQ ID NO: 7164 - RNA, 22 nt, Homo sapiens
ggaaucccaggccggucagccc

SEQ ID NO: 7165 - RNA, 22 nt, Homo sapiens
gaaucccaggccggucagcccg

SEQ ID NO: 7166 - RNA, 22 nt, Homo sapiens
aaucccaggccggucagcccgg

SEQ ID NO: 7167 - RNA, 22 nt, Homo sapiens
aucccaggccggucagcccggu

SEQ ID NO: 7168 - RNA, 22 nt, Homo sapiens
ucccaggccggucagcccggug

SEQ ID NO: 7169 - RNA, 22 nt, Homo sapiens
cccaggccggucagcccggugg

SEQ ID NO: 7170 - RNA, 22 nt, Homo sapiens
ccaggccggucagcccggugga

SEQ ID NO: 7171 - RNA, 22 nt, Homo sapiens
caggccggucagcccgguggag

SEQ ID NO: 7172 - RNA, 22 nt, Homo sapiens
aggccggucagcccgguggagg

SEQ ID NO: 7173 - RNA, 22 nt, Homo sapiens
ggccggucagcccgguggaggg

SEQ ID NO: 7174 - RNA, 22 nt, Homo sapiens
gccggucagcccgguggagggg

SEQ ID NO: 7175 - RNA, 22 nt, Homo sapiens
ccggucagcccgguggaggggg

SEQ ID NO: 7176 - RNA, 22 nt, Homo sapiens
cggucagcccgguggagggggc

SEQ ID NO: 7177 - RNA, 22 nt, Homo sapiens
ggucagcccgguggagggggcg

SEQ ID NO: 7178 - RNA, 22 nt, Homo sapiens
gucagcccgguggagggggcgg

SEQ ID NO: 7179 - RNA, 22 nt, Homo sapiens
ucagcccgguggagggggcggg

SEQ ID NO: 7180 - RNA, 22 nt, Homo sapiens
cagcccgguggagggggcgggg

SEQ ID NO: 7181 - RNA, 22 nt, Homo sapiens
agcccgguggagggggcggggc

SEQ ID NO: 7182 - RNA, 22 nt, Homo sapiens
gcccgguggagggggcggggcg

SEQ ID NO: 7183 - RNA, 22 nt, Homo sapiens
cccgguggagggggcggggcgg

SEQ ID NO: 7184 - RNA, 22 nt, Homo sapiens
ccgguggagggggcggggcgga

SEQ ID NO: 7185 - RNA, 22 nt, Homo sapiens
cgguggagggggcggggcggag

SEQ ID NO: 7186 - RNA, 22 nt, Homo sapiens
gguggagggggcggggcggaga

SEQ ID NO: 7187 - RNA, 22 nt, Homo sapiens
guggagggggcggggcggagac

SEQ ID NO: 7188 - RNA, 22 nt, Homo sapiens
uggagggggcggggcggagaca

SEQ ID NO: 7189 - RNA, 22 nt, Homo sapiens
ggagggggcggggcggagacac

SEQ ID NO: 7190 - RNA, 22 nt, Homo sapiens
gagggggcggggcggagacacg

SEQ ID NO: 7191 - RNA, 22 nt, Homo sapiens
agggggcggggcggagacacgc

SEQ ID NO: 7192 - RNA, 22 nt, Homo sapiens
gggggcggggcggagacacgcc

SEQ ID NO: 7193 - RNA, 22 nt, Homo sapiens
ggggcggggcggagacacgccc

SEQ ID NO: 7194 - RNA, 22 nt, Homo sapiens
gggcggggcggagacacgcccc

SEQ ID NO: 7195 - RNA, 22 nt, Homo sapiens
ggcggggcggagacacgccccu

SEQ ID NO: 7196 - RNA, 22 nt, Homo sapiens
gcggggcggagacacgccccuc

SEQ ID NO: 7197 - RNA, 22 nt, Homo sapiens
cggggcggagacacgccccucc

SEQ ID NO: 7198 - RNA, 22 nt, Homo sapiens
ggggcggagacacgccccuccg

SEQ ID NO: 7199 - RNA, 22 nt, Homo sapiens
gggcggagacacgccccuccgu

SEQ ID NO: 7200 - RNA, 22 nt, Homo sapiens
ggcggagacacgccccuccgua

SEQ ID NO: 7201 - RNA, 22 nt, Homo sapiens
gcggagacacgccccuccguag

SEQ ID NO: 7202 - RNA, 22 nt, Homo sapiens
cggagacacgccccuccguagc

SEQ ID NO: 7203 - RNA, 22 nt, Homo sapiens
ggagacacgccccuccguagcc

SEQ ID NO: 7204 - RNA, 22 nt, Homo sapiens
gagacacgccccuccguagcca

SEQ ID NO: 7205 - RNA, 22 nt, Homo sapiens
agacacgccccuccguagccag

SEQ ID NO: 7206 - RNA, 22 nt, Homo sapiens
gacacgccccuccguagccagc

SEQ ID NO: 7207 - RNA, 22 nt, Homo sapiens
acacgccccuccguagccagcc

SEQ ID NO: 7208 - RNA, 22 nt, Homo sapiens
cacgccccuccguagccagcca

SEQ ID NO: 7209 - RNA, 22 nt, Homo sapiens
acgccccuccguagccagccag

SEQ ID NO: 7210 - RNA, 22 nt, Homo sapiens
cgccccuccguagccagccagg

SEQ ID NO: 7211 - RNA, 22 nt, Homo sapiens
gccccuccguagccagccaggu

SEQ ID NO: 7212 - RNA, 22 nt, Homo sapiens
ccccuccguagccagccaggug

SEQ ID NO: 7213 - RNA, 22 nt, Homo sapiens
cccuccguagccagccaggugu

SEQ ID NO: 7214 - RNA, 22 nt, Homo sapiens
ccuccguagccagccagguguu

SEQ ID NO: 7215 - RNA, 22 nt, Homo sapiens
cuccguagccagccagguguuc

SEQ ID NO: 7216 - RNA, 22 nt, Homo sapiens
uccguagccagccagguguucc

SEQ ID NO: 7217 - RNA, 22 nt, Homo sapiens
ccguagccagccagguguuccc

SEQ ID NO: 7218 - RNA, 22 nt, Homo sapiens
cguagccagccagguguucccc

SEQ ID NO: 7219 - RNA, 22 nt, Homo sapiens
guagccagccagguguuccccg

SEQ ID NO: 7220 - RNA, 22 nt, Homo sapiens
uagccagccagguguuccccgc

SEQ ID NO: 7221 - RNA, 22 nt, Homo sapiens
agccagccagguguuccccgcg

SEQ ID NO: 7222 - RNA, 22 nt, Homo sapiens
gccagccagguguuccccgcga

SEQ ID NO: 7223 - RNA, 22 nt, Homo sapiens
ccagccagguguuccccgcgaa

SEQ ID NO: 7224 - RNA, 22 nt, Homo sapiens
cagccagguguuccccgcgaaa

SEQ ID NO: 7225 - RNA, 22 nt, Homo sapiens
agccagguguuccccgcgaaag

SEQ ID NO: 7226 - RNA, 22 nt, Homo sapiens
gccagguguuccccgcgaaaga

SEQ ID NO: 7227 - RNA, 22 nt, Homo sapiens
ccagguguuccccgcgaaagag

SEQ ID NO: 7228 - RNA, 22 nt, Homo sapiens
cagguguuccccgcgaaagaga

SEQ ID NO: 7229 - RNA, 22 nt, Homo sapiens
agguguuccccgcgaaagagag

SEQ ID NO: 7230 - RNA, 22 nt, Homo sapiens
gguguuccccgcgaaagagagg

SEQ ID NO: 7231 - RNA, 22 nt, Homo sapiens
guguuccccgcgaaagagaggc

SEQ ID NO: 7232 - RNA, 22 nt, Homo sapiens
uguuccccgcgaaagagaggcc

SEQ ID NO: 7233 - RNA, 22 nt, Homo sapiens
guuccccgcgaaagagaggcca

SEQ ID NO: 7234 - RNA, 22 nt, Homo sapiens
uuccccgcgaaagagaggccac

SEQ ID NO: 7235 - RNA, 22 nt, Homo sapiens
uccccgcgaaagagaggccacg

SEQ ID NO: 7236 - RNA, 22 nt, Homo sapiens
ccccgcgaaagagaggccacgg

SEQ ID NO: 7237 - RNA, 22 nt, Homo sapiens
cccgcgaaagagaggccacggc

SEQ ID NO: 7238 - RNA, 22 nt, Homo sapiens
ccgcgaaagagaggccacggcc

SEQ ID NO: 7239 - RNA, 22 nt, Homo sapiens
cgcgaaagagaggccacggccc

SEQ ID NO: 7240 - RNA, 22 nt, Homo sapiens
gcgaaagagaggccacggcccu

SEQ ID NO: 7241 - RNA, 22 nt, Homo sapiens
cgaaagagaggccacggcccug

SEQ ID NO: 7242 - RNA, 22 nt, Homo sapiens
gaaagagaggccacggcccugc

SEQ ID NO: 7243 - RNA, 22 nt, Homo sapiens
aaagagaggccacggcccugcc

SEQ ID NO: 7244 - RNA, 22 nt, Homo sapiens
aagagaggccacggcccugccc

SEQ ID NO: 7245 - RNA, 22 nt, Homo sapiens
agagaggccacggcccugcccc

SEQ ID NO: 7246 - RNA, 22 nt, Homo sapiens
gagaggccacggcccugccccg

SEQ ID NO: 7247 - RNA, 22 nt, Homo sapiens
agaggccacggcccugccccga

SEQ ID NO: 7248 - RNA, 22 nt, Homo sapiens
gaggccacggcccugccccgaa

SEQ ID NO: 7249 - RNA, 22 nt, Homo sapiens
aggccacggcccugccccgaac

SEQ ID NO: 7250 - RNA, 22 nt, Homo sapiens
ggccacggcccugccccgaacc

SEQ ID NO: 7251 - RNA, 22 nt, Homo sapiens
gccacggcccugccccgaacca

SEQ ID NO: 7252 - RNA, 22 nt, Homo sapiens
ccacggcccugccccgaaccac

SEQ ID NO: 7253 - RNA, 22 nt, Homo sapiens
cacggcccugccccgaaccacc

SEQ ID NO: 7254 - RNA, 22 nt, Homo sapiens
acggcccugccccgaaccaccc

SEQ ID NO: 7255 - RNA, 22 nt, Homo sapiens
cggcccugccccgaaccacccg

SEQ ID NO: 7256 - RNA, 22 nt, Homo sapiens
ggcccugccccgaaccacccga

SEQ ID NO: 7257 - RNA, 22 nt, Homo sapiens
gcccugccccgaaccacccgac

SEQ ID NO: 7258 - RNA, 22 nt, Homo sapiens
cccugccccgaaccacccgacc

SEQ ID NO: 7259 - RNA, 22 nt, Homo sapiens
ccugccccgaaccacccgaccc

SEQ ID NO: 7260 - RNA, 22 nt, Homo sapiens
cugccccgaaccacccgacccc

SEQ ID NO: 7261 - RNA, 22 nt, Homo sapiens
ugccccgaaccacccgaccccg

SEQ ID NO: 7262 - RNA, 22 nt, Homo sapiens
gccccgaaccacccgaccccgu

SEQ ID NO: 7263 - RNA, 22 nt, Homo sapiens
ccccgaaccacccgaccccguc

SEQ ID NO: 7264 - RNA, 22 nt, Homo sapiens
cccgaaccacccgaccccgucc

SEQ ID NO: 7265 - RNA, 22 nt, Homo sapiens
ccgaaccacccgaccccguccc

SEQ ID NO: 7266 - RNA, 22 nt, Homo sapiens
cgaaccacccgaccccguccca

SEQ ID NO: 7267 - RNA, 22 nt, Homo sapiens
gaaccacccgaccccgucccaa

SEQ ID NO: 7268 - RNA, 22 nt, Homo sapiens
aaccacccgaccccgucccaac

SEQ ID NO: 7269 - RNA, 22 nt, Homo sapiens
accacccgaccccgucccaacc

SEQ ID NO: 7270 - RNA, 22 nt, Homo sapiens
ccacccgaccccgucccaaccc

SEQ ID NO: 7271 - RNA, 22 nt, Homo sapiens
cacccgaccccgucccaacccc

SEQ ID NO: 7272 - RNA, 22 nt, Homo sapiens
acccgaccccgucccaaccccg

SEQ ID NO: 7273 - RNA, 22 nt, Homo sapiens
cccgaccccgucccaaccccgc

SEQ ID NO: 7274 - RNA, 22 nt, Homo sapiens
ccgaccccgucccaaccccgcg

SEQ ID NO: 7275 - RNA, 22 nt, Homo sapiens
cgaccccgucccaaccccgcgu

SEQ ID NO: 7276 - RNA, 22 nt, Homo sapiens
gaccccgucccaaccccgcguc

SEQ ID NO: 7277 - RNA, 22 nt, Homo sapiens
accccgucccaaccccgcgucc

SEQ ID NO: 7278 - RNA, 22 nt, Homo sapiens
ccccgucccaaccccgcguccu

SEQ ID NO: 7279 - RNA, 22 nt, Homo sapiens
cccgucccaaccccgcguccua

SEQ ID NO: 7280 - RNA, 22 nt, Homo sapiens
ccgucccaaccccgcguccuaa

SEQ ID NO: 7281 - RNA, 22 nt, Homo sapiens
cgucccaaccccgcguccuaaa

SEQ ID NO: 7282 - RNA, 22 nt, Homo sapiens
gucccaaccccgcguccuaaag

SEQ ID NO: 7283 - RNA, 22 nt, Homo sapiens
ucccaaccccgcguccuaaagc

SEQ ID NO: 7284 - RNA, 22 nt, Homo sapiens
cccaaccccgcguccuaaagcu

SEQ ID NO: 7285 - RNA, 22 nt, Homo sapiens
ccaaccccgcguccuaaagcuc

SEQ ID NO: 7286 - RNA, 22 nt, Homo sapiens
caaccccgcguccuaaagcucc

SEQ ID NO: 7287 - RNA, 22 nt, Homo sapiens
aaccccgcguccuaaagcuccu

SEQ ID NO: 7288 - RNA, 22 nt, Homo sapiens
accccgcguccuaaagcuccuc

SEQ ID NO: 7289 - RNA, 22 nt, Homo sapiens
ccccgcguccuaaagcuccucc

SEQ ID NO: 7290 - RNA, 22 nt, Homo sapiens
cccgcguccuaaagcuccucca

SEQ ID NO: 7291 - RNA, 22 nt, Homo sapiens
ccgcguccuaaagcuccuccag

SEQ ID NO: 7292 - RNA, 22 nt, Homo sapiens
cgcguccuaaagcuccuccagc

SEQ ID NO: 7293 - RNA, 22 nt, Homo sapiens
gcguccuaaagcuccuccagca

SEQ ID NO: 7294 - RNA, 22 nt, Homo sapiens
cguccuaaagcuccuccagcag

SEQ ID NO: 7295 - RNA, 22 nt, Homo sapiens
guccuaaagcuccuccagcaga

SEQ ID NO: 7296 - RNA, 22 nt, Homo sapiens
uccuaaagcuccuccagcagag

SEQ ID NO: 7297 - RNA, 22 nt, Homo sapiens
ccuaaagcuccuccagcagagc

SEQ ID NO: 7298 - RNA, 22 nt, Homo sapiens
cuaaagcuccuccagcagagcc

SEQ ID NO: 7299 - RNA, 22 nt, Homo sapiens
uaaagcuccuccagcagagccc

SEQ ID NO: 7300 - RNA, 22 nt, Homo sapiens
aaagcuccuccagcagagcccg

SEQ ID NO: 7301 - RNA, 22 nt, Homo sapiens
aagcuccuccagcagagcccgg

SEQ ID NO: 7302 - RNA, 22 nt, Homo sapiens
agcuccuccagcagagcccggu

SEQ ID NO: 7303 - RNA, 22 nt, Homo sapiens
gcuccuccagcagagcccggua

SEQ ID NO: 7304 - RNA, 22 nt, Homo sapiens
cuccuccagcagagcccgguau

SEQ ID NO: 7305 - RNA, 22 nt, Homo sapiens
uccuccagcagagcccgguauu

SEQ ID NO: 7306 - RNA, 22 nt, Homo sapiens
ccuccagcagagcccgguauuc

SEQ ID NO: 7307 - RNA, 22 nt, Homo sapiens
cuccagcagagcccgguauucu

SEQ ID NO: 7308 - RNA, 22 nt, Homo sapiens
uccagcagagcccgguauucuu

SEQ ID NO: 7309 - RNA, 22 nt, Homo sapiens
ccagcagagcccgguauucuuc

SEQ ID NO: 7310 - RNA, 22 nt, Homo sapiens
cagcagagcccgguauucuucc

SEQ ID NO: 7311 - RNA, 22 nt, Homo sapiens
agcagagcccgguauucuuccu

SEQ ID NO: 7312 - RNA, 22 nt, Homo sapiens
gcagagcccgguauucuuccuc

SEQ ID NO: 7313 - RNA, 22 nt, Homo sapiens
cagagcccgguauucuuccucg

SEQ ID NO: 7314 - RNA, 22 nt, Homo sapiens
agagcccgguauucuuccucgc

SEQ ID NO: 7315 - RNA, 22 nt, Homo sapiens
gagcccgguauucuuccucgcu

SEQ ID NO: 7316 - RNA, 22 nt, Homo sapiens
agcccgguauucuuccucgcug

SEQ ID NO: 7317 - RNA, 22 nt, Homo sapiens
gcccgguauucuuccucgcuga

SEQ ID NO: 7318 - RNA, 22 nt, Homo sapiens
cccgguauucuuccucgcugag

SEQ ID NO: 7319 - RNA, 22 nt, Homo sapiens
ccgguauucuuccucgcugagg

SEQ ID NO: 7320 - RNA, 22 nt, Homo sapiens
cgguauucuuccucgcugaggg

SEQ ID NO: 7321 - RNA, 22 nt, Homo sapiens
gguauucuuccucgcugagggg

SEQ ID NO: 7322 - RNA, 22 nt, Homo sapiens
guauucuuccucgcugaggggu

SEQ ID NO: 7323 - RNA, 22 nt, Homo sapiens
uauucuuccucgcugaggggug

SEQ ID NO: 7324 - RNA, 22 nt, Homo sapiens
auucuuccucgcugaggggugc

SEQ ID NO: 7325 - RNA, 22 nt, Homo sapiens
uucuuccucgcugaggggugcu

SEQ ID NO: 7326 - RNA, 22 nt, Homo sapiens
ucuuccucgcugaggggugcuu

SEQ ID NO: 7327 - RNA, 22 nt, Homo sapiens
cuuccucgcugaggggugcuuc

SEQ ID NO: 7328 - RNA, 22 nt, Homo sapiens
uuccucgcugaggggugcuucc

SEQ ID NO: 7329 - RNA, 22 nt, Homo sapiens
uccucgcugaggggugcuucca

SEQ ID NO: 7330 - RNA, 22 nt, Homo sapiens
ccucgcugaggggugcuuccag

SEQ ID NO: 7331 - RNA, 22 nt, Homo sapiens
cucgcugaggggugcuuccagc

SEQ ID NO: 7332 - RNA, 22 nt, Homo sapiens
ucgcugaggggugcuuccagcg

SEQ ID NO: 7333 - RNA, 22 nt, Homo sapiens
cgcugaggggugcuuccagcga

SEQ ID NO: 7334 - RNA, 22 nt, Homo sapiens
gcugaggggugcuuccagcgag

SEQ ID NO: 7335 - RNA, 22 nt, Homo sapiens
cugaggggugcuuccagcgagg

SEQ ID NO: 7336 - RNA, 22 nt, Homo sapiens
ugaggggugcuuccagcgaggc

SEQ ID NO: 7337 - RNA, 22 nt, Homo sapiens
gaggggugcuuccagcgaggcg

SEQ ID NO: 7338 - RNA, 22 nt, Homo sapiens
aggggugcuuccagcgaggcgg

SEQ ID NO: 7339 - RNA, 22 nt, Homo sapiens
ggggugcuuccagcgaggcggc

SEQ ID NO: 7340 - RNA, 22 nt, Homo sapiens
gggugcuuccagcgaggcggcc

SEQ ID NO: 7341 - RNA, 22 nt, Homo sapiens
ggugcuuccagcgaggcggccu

SEQ ID NO: 7342 - RNA, 22 nt, Homo sapiens
gugcuuccagcgaggcggccuc

SEQ ID NO: 7343 - RNA, 22 nt, Homo sapiens
ugcuuccagcgaggcggccucu

SEQ ID NO: 7344 - RNA, 22 nt, Homo sapiens
gcuuccagcgaggcggccucuu

SEQ ID NO: 7345 - RNA, 22 nt, Homo sapiens
cuuccagcgaggcggccucuuc

SEQ ID NO: 7346 - RNA, 22 nt, Homo sapiens
uuccagcgaggcggccucuucc

SEQ ID NO: 7347 - RNA, 22 nt, Homo sapiens
uccagcgaggcggccucuuccg

SEQ ID NO: 7348 - RNA, 22 nt, Homo sapiens
ccagcgaggcggccucuuccga

SEQ ID NO: 7349 - RNA, 22 nt, Homo sapiens
cagcgaggcggccucuuccgag

SEQ ID NO: 7350 - RNA, 22 nt, Homo sapiens
agcgaggcggccucuuccgagg

SEQ ID NO: 7351 - RNA, 22 nt, Homo sapiens
gcgaggcggccucuuccgaggc

SEQ ID NO: 7352 - RNA, 22 nt, Homo sapiens
cgaggcggccucuuccgaggcc

SEQ ID NO: 7353 - RNA, 22 nt, Homo sapiens
gaggcggccucuuccgaggccu

SEQ ID NO: 7354 - RNA, 22 nt, Homo sapiens
aggcggccucuuccgaggccuc

SEQ ID NO: 7355 - RNA, 22 nt, Homo sapiens
ggcggccucuuccgaggccucc

SEQ ID NO: 7356 - RNA, 22 nt, Homo sapiens
gcggccucuuccgaggccucca

SEQ ID NO: 7357 - RNA, 22 nt, Homo sapiens
cggccucuuccgaggccuccag

SEQ ID NO: 7358 - RNA, 22 nt, Homo sapiens
ggccucuuccgaggccuccagc

SEQ ID NO: 7359 - RNA, 22 nt, Homo sapiens
gccucuuccgaggccuccagcu

SEQ ID NO: 7360 - RNA, 22 nt, Homo sapiens
ccucuuccgaggccuccagcuc

SEQ ID NO: 7361 - RNA, 22 nt, Homo sapiens
cucuuccgaggccuccagcucc

SEQ ID NO: 7362 - RNA, 22 nt, Homo sapiens
ucuuccgaggccuccagcuccc

SEQ ID NO: 7363 - RNA, 22 nt, Homo sapiens
cuuccgaggccuccagcucccc

SEQ ID NO: 7364 - RNA, 22 nt, Homo sapiens
uuccgaggccuccagcuccccc

SEQ ID NO: 7365 - RNA, 22 nt, Homo sapiens
uccgaggccuccagcucccccg

SEQ ID NO: 7366 - RNA, 22 nt, Homo sapiens
ccgaggccuccagcucccccgg

SEQ ID NO: 7367 - RNA, 22 nt, Homo sapiens
cgaggccuccagcucccccggg

SEQ ID NO: 7368 - RNA, 22 nt, Homo sapiens
gaggccuccagcucccccgggg

SEQ ID NO: 7369 - RNA, 22 nt, Homo sapiens
aggccuccagcucccccggggc

SEQ ID NO: 7370 - RNA, 22 nt, Homo sapiens
ggccuccagcucccccggggcc

SEQ ID NO: 7371 - RNA, 22 nt, Homo sapiens
gccuccagcucccccggggccu

SEQ ID NO: 7372 - RNA, 22 nt, Homo sapiens
ccuccagcucccccggggccuc

SEQ ID NO: 7373 - RNA, 22 nt, Homo sapiens
cuccagcucccccggggccucc

SEQ ID NO: 7374 - RNA, 22 nt, Homo sapiens
uccagcucccccggggccuccg

SEQ ID NO: 7375 - RNA, 22 nt, Homo sapiens
ccagcucccccggggccuccgu

SEQ ID NO: 7376 - RNA, 22 nt, Homo sapiens
cagcucccccggggccuccguu

SEQ ID NO: 7377 - RNA, 22 nt, Homo sapiens
agcucccccggggccuccguuu

SEQ ID NO: 7378 - RNA, 22 nt, Homo sapiens
gcucccccggggccuccguuuc

SEQ ID NO: 7379 - RNA, 22 nt, Homo sapiens
cucccccggggccuccguuucu

SEQ ID NO: 7380 - RNA, 22 nt, Homo sapiens
ucccccggggccuccguuucua

SEQ ID NO: 7381 - RNA, 22 nt, Homo sapiens
cccccggggccuccguuucuag

SEQ ID NO: 7382 - RNA, 22 nt, Homo sapiens
ccccggggccuccguuucuagg

SEQ ID NO: 7383 - RNA, 22 nt, Homo sapiens
cccggggccuccguuucuagga

SEQ ID NO: 7384 - RNA, 22 nt, Homo sapiens
ccggggccuccguuucuaggag

SEQ ID NO: 7385 - RNA, 22 nt, Homo sapiens
cggggccuccguuucuaggaga

SEQ ID NO: 7386 - RNA, 22 nt, Homo sapiens
ggggccuccguuucuaggagag

SEQ ID NO: 7387 - RNA, 22 nt, Homo sapiens
gggccuccguuucuaggagagg

SEQ ID NO: 7388 - RNA, 22 nt, Homo sapiens
ggccuccguuucuaggagaggu

SEQ ID NO: 7389 - RNA, 22 nt, Homo sapiens
gccuccguuucuaggagagguu

SEQ ID NO: 7390 - RNA, 22 nt, Homo sapiens
ccuccguuucuaggagagguug

SEQ ID NO: 7391 - RNA, 22 nt, Homo sapiens
cuccguuucuaggagagguugc

SEQ ID NO: 7392 - RNA, 22 nt, Homo sapiens
uccguuucuaggagagguugcg

SEQ ID NO: 7393 - RNA, 22 nt, Homo sapiens
ccguuucuaggagagguugcgc

SEQ ID NO: 7394 - RNA, 22 nt, Homo sapiens
cguuucuaggagagguugcgcc

SEQ ID NO: 7395 - RNA, 22 nt, Homo sapiens
guuucuaggagagguugcgccu

SEQ ID NO: 7396 - RNA, 22 nt, Homo sapiens
uuucuaggagagguugcgccug

SEQ ID NO: 7397 - RNA, 22 nt, Homo sapiens
uucuaggagagguugcgccugc

SEQ ID NO: 7398 - RNA, 22 nt, Homo sapiens
ucuaggagagguugcgccugcu

SEQ ID NO: 7399 - RNA, 22 nt, Homo sapiens
cuaggagagguugcgccugcug

SEQ ID NO: 7400 - RNA, 22 nt, Homo sapiens
uaggagagguugcgccugcugc

SEQ ID NO: 7401 - RNA, 22 nt, Homo sapiens
aggagagguugcgccugcugca

SEQ ID NO: 7402 - RNA, 22 nt, Homo sapiens
ggagagguugcgccugcugcag

SEQ ID NO: 7403 - RNA, 22 nt, Homo sapiens
gagagguugcgccugcugcaga

SEQ ID NO: 7404 - RNA, 22 nt, Homo sapiens
agagguugcgccugcugcagaa

SEQ ID NO: 7405 - RNA, 22 nt, Homo sapiens
gagguugcgccugcugcagaaa

SEQ ID NO: 7406 - RNA, 22 nt, Homo sapiens
agguugcgccugcugcagaaac

SEQ ID NO: 7407 - RNA, 22 nt, Homo sapiens
gguugcgccugcugcagaaacu

SEQ ID NO: 7408 - RNA, 22 nt, Homo sapiens
guugcgccugcugcagaaacuc

SEQ ID NO: 7409 - RNA, 22 nt, Homo sapiens
uugcgccugcugcagaaacucc

SEQ ID NO: 7410 - RNA, 22 nt, Homo sapiens
ugcgccugcugcagaaacuccg

SEQ ID NO: 7411 - RNA, 22 nt, Homo sapiens
gcgccugcugcagaaacuccgg

SEQ ID NO: 7412 - RNA, 22 nt, Homo sapiens
cgccugcugcagaaacuccggg

SEQ ID NO: 7413 - RNA, 22 nt, Homo sapiens
gccugcugcagaaacuccgggc

SEQ ID NO: 7414 - RNA, 22 nt, Homo sapiens
ccugcugcagaaacuccgggcu

SEQ ID NO: 7415 - RNA, 22 nt, Homo sapiens
cugcugcagaaacuccgggcuc

SEQ ID NO: 7416 - RNA, 22 nt, Homo sapiens
ugcugcagaaacuccgggcucg

SEQ ID NO: 7417 - RNA, 22 nt, Homo sapiens
gcugcagaaacuccgggcucgc

SEQ ID NO: 7418 - RNA, 22 nt, Homo sapiens
cugcagaaacuccgggcucgcc

SEQ ID NO: 7419 - RNA, 22 nt, Homo sapiens
ugcagaaacuccgggcucgcca

SEQ ID NO: 7420 - RNA, 22 nt, Homo sapiens
gcagaaacuccgggcucgccag

SEQ ID NO: 7421 - RNA, 22 nt, Homo sapiens
cagaaacuccgggcucgccagg

SEQ ID NO: 7422 - RNA, 22 nt, Homo sapiens
agaaacuccgggcucgccagga

SEQ ID NO: 7423 - RNA, 22 nt, Homo sapiens
gaaacuccgggcucgccaggag

SEQ ID NO: 7424 - RNA, 22 nt, Homo sapiens
aaacuccgggcucgccaggagc

SEQ ID NO: 7425 - RNA, 22 nt, Homo sapiens
aacuccgggcucgccaggagcu

SEQ ID NO: 7426 - RNA, 22 nt, Homo sapiens
acuccgggcucgccaggagcuc

SEQ ID NO: 7427 - RNA, 22 nt, Homo sapiens
cuccgggcucgccaggagcuca

SEQ ID NO: 7428 - RNA, 22 nt, Homo sapiens
uccgggcucgccaggagcucau

SEQ ID NO: 7429 - RNA, 22 nt, Homo sapiens
ccgggcucgccaggagcucauc

SEQ ID NO: 7430 - RNA, 22 nt, Homo sapiens
cgggcucgccaggagcucaucc

SEQ ID NO: 7431 - RNA, 22 nt, Homo sapiens
gggcucgccaggagcucaucca

SEQ ID NO: 7432 - RNA, 22 nt, Homo sapiens
ggcucgccaggagcucauccag

SEQ ID NO: 7433 - RNA, 22 nt, Homo sapiens
gcucgccaggagcucauccagc

SEQ ID NO: 7434 - RNA, 22 nt, Homo sapiens
cucgccaggagcucauccagca

SEQ ID NO: 7435 - RNA, 22 nt, Homo sapiens
ucgccaggagcucauccagcag

SEQ ID NO: 7436 - RNA, 22 nt, Homo sapiens
cgccaggagcucauccagcagc

SEQ ID NO: 7437 - RNA, 22 nt, Homo sapiens
gccaggagcucauccagcagca

SEQ ID NO: 7438 - RNA, 22 nt, Homo sapiens
ccaggagcucauccagcagcag

SEQ ID NO: 7439 - RNA, 22 nt, Homo sapiens
caggagcucauccagcagcagg

SEQ ID NO: 7440 - RNA, 22 nt, Homo sapiens
aggagcucauccagcagcaggc

SEQ ID NO: 7441 - RNA, 22 nt, Homo sapiens
ggagcucauccagcagcaggcc

SEQ ID NO: 7442 - RNA, 22 nt, Homo sapiens
gagcucauccagcagcaggccg

SEQ ID NO: 7443 - RNA, 22 nt, Homo sapiens
agcucauccagcagcaggccgc

SEQ ID NO: 7444 - RNA, 22 nt, Homo sapiens
gcucauccagcagcaggccgca

SEQ ID NO: 7445 - RNA, 22 nt, Homo sapiens
cucauccagcagcaggccgcag

SEQ ID NO: 7446 - RNA, 22 nt, Homo sapiens
ucauccagcagcaggccgcagg

SEQ ID NO: 7447 - RNA, 22 nt, Homo sapiens
cauccagcagcaggccgcaggg

SEQ ID NO: 7448 - RNA, 22 nt, Homo sapiens
auccagcagcaggccgcagggg

SEQ ID NO: 7449 - RNA, 22 nt, Homo sapiens
uccagcagcaggccgcagggga

SEQ ID NO: 7450 - RNA, 22 nt, Homo sapiens
ccagcagcaggccgcaggggag

SEQ ID NO: 7451 - RNA, 22 nt, Homo sapiens
cagcagcaggccgcaggggagu

SEQ ID NO: 7452 - RNA, 22 nt, Homo sapiens
agcagcaggccgcaggggagug

SEQ ID NO: 7453 - RNA, 22 nt, Homo sapiens
gcagcaggccgcaggggagugc

SEQ ID NO: 7454 - RNA, 22 nt, Homo sapiens
cagcaggccgcaggggagugca

SEQ ID NO: 7455 - RNA, 22 nt, Homo sapiens
agcaggccgcaggggagugcag

SEQ ID NO: 7456 - RNA, 22 nt, Homo sapiens
gcaggccgcaggggagugcaga

SEQ ID NO: 7457 - RNA, 22 nt, Homo sapiens
caggccgcaggggagugcagac

SEQ ID NO: 7458 - RNA, 22 nt, Homo sapiens
aggccgcaggggagugcagacc

SEQ ID NO: 7459 - RNA, 22 nt, Homo sapiens
ggccgcaggggagugcagacca

SEQ ID NO: 7460 - RNA, 22 nt, Homo sapiens
gccgcaggggagugcagaccag

SEQ ID NO: 7461 - RNA, 22 nt, Homo sapiens
ccgcaggggagugcagaccagg

SEQ ID NO: 7462 - RNA, 22 nt, Homo sapiens
cgcaggggagugcagaccaggg

SEQ ID NO: 7463 - RNA, 22 nt, Homo sapiens
gcaggggagugcagaccagggc

SEQ ID NO: 7464 - RNA, 22 nt, Homo sapiens
caggggagugcagaccagggcg

SEQ ID NO: 7465 - RNA, 22 nt, Homo sapiens
aggggagugcagaccagggcgc

SEQ ID NO: 7466 - RNA, 22 nt, Homo sapiens
ggggagugcagaccagggcgcc

SEQ ID NO: 7467 - RNA, 22 nt, Homo sapiens
gggagugcagaccagggcgccg

SEQ ID NO: 7468 - RNA, 22 nt, Homo sapiens
ggagugcagaccagggcgccgg

SEQ ID NO: 7469 - RNA, 22 nt, Homo sapiens
gagugcagaccagggcgccggc

SEQ ID NO: 7470 - RNA, 22 nt, Homo sapiens
agugcagaccagggcgccggcu

SEQ ID NO: 7471 - RNA, 22 nt, Homo sapiens
gugcagaccagggcgccggcuc

SEQ ID NO: 7472 - RNA, 22 nt, Homo sapiens
ugcagaccagggcgccggcucc

SEQ ID NO: 7473 - RNA, 22 nt, Homo sapiens
gcagaccagggcgccggcuccu

SEQ ID NO: 7474 - RNA, 22 nt, Homo sapiens
cagaccagggcgccggcuccug

SEQ ID NO: 7475 - RNA, 22 nt, Homo sapiens
agaccagggcgccggcuccugg

SEQ ID NO: 7476 - RNA, 22 nt, Homo sapiens
gaccagggcgccggcuccugga

SEQ ID NO: 7477 - RNA, 22 nt, Homo sapiens
accagggcgccggcuccuggag

SEQ ID NO: 7478 - RNA, 22 nt, Homo sapiens
ccagggcgccggcuccuggagc

SEQ ID NO: 7479 - RNA, 22 nt, Homo sapiens
cagggcgccggcuccuggagcg

SEQ ID NO: 7480 - RNA, 22 nt, Homo sapiens
agggcgccggcuccuggagcgc

SEQ ID NO: 7481 - RNA, 22 nt, Homo sapiens
gggcgccggcuccuggagcgcc

SEQ ID NO: 7482 - RNA, 22 nt, Homo sapiens
ggcgccggcuccuggagcgccu

SEQ ID NO: 7483 - RNA, 22 nt, Homo sapiens
gcgccggcuccuggagcgccug

SEQ ID NO: 7484 - RNA, 22 nt, Homo sapiens
cgccggcuccuggagcgccugg

SEQ ID NO: 7485 - RNA, 22 nt, Homo sapiens
gccggcuccuggagcgccuggg

SEQ ID NO: 7486 - RNA, 22 nt, Homo sapiens
ccggcuccuggagcgccuggga

SEQ ID NO: 7487 - RNA, 22 nt, Homo sapiens
cggcuccuggagcgccugggag

SEQ ID NO: 7488 - RNA, 22 nt, Homo sapiens
ggcuccuggagcgccugggagg

SEQ ID NO: 7489 - RNA, 22 nt, Homo sapiens
gcuccuggagcgccugggaggg

SEQ ID NO: 7490 - RNA, 22 nt, Homo sapiens
cuccuggagcgccugggagggc

SEQ ID NO: 7491 - RNA, 22 nt, Homo sapiens
uccuggagcgccugggagggcg

SEQ ID NO: 7492 - RNA, 22 nt, Homo sapiens
ccuggagcgccugggagggcgc

SEQ ID NO: 7493 - RNA, 22 nt, Homo sapiens
cuggagcgccugggagggcgcc

SEQ ID NO: 7494 - RNA, 22 nt, Homo sapiens
uggagcgccugggagggcgccg

SEQ ID NO: 7495 - RNA, 22 nt, Homo sapiens
ggagcgccugggagggcgccgg

SEQ ID NO: 7496 - RNA, 22 nt, Homo sapiens
gagcgccugggagggcgccggg

SEQ ID NO: 7497 - RNA, 22 nt, Homo sapiens
agcgccugggagggcgccggga

SEQ ID NO: 7498 - RNA, 22 nt, Homo sapiens
gcgccugggagggcgccgggau

SEQ ID NO: 7499 - RNA, 22 nt, Homo sapiens
cgccugggagggcgccgggaug

SEQ ID NO: 7500 - RNA, 22 nt, Homo sapiens
gccugggagggcgccgggaugc

SEQ ID NO: 7501 - RNA, 22 nt, Homo sapiens
ccugggagggcgccgggaugcc

SEQ ID NO: 7502 - RNA, 22 nt, Homo sapiens
cugggagggcgccgggaugccu

SEQ ID NO: 7503 - RNA, 22 nt, Homo sapiens
ugggagggcgccgggaugccuu

SEQ ID NO: 7504 - RNA, 22 nt, Homo sapiens
gggagggcgccgggaugccuug

SEQ ID NO: 7505 - RNA, 22 nt, Homo sapiens
ggagggcgccgggaugccuugc

SEQ ID NO: 7506 - RNA, 22 nt, Homo sapiens
gagggcgccgggaugccuugca

SEQ ID NO: 7507 - RNA, 22 nt, Homo sapiens
agggcgccgggaugccuugcau

SEQ ID NO: 7508 - RNA, 22 nt, Homo sapiens
gggcgccgggaugccuugcauc

SEQ ID NO: 7509 - RNA, 22 nt, Homo sapiens
ggcgccgggaugccuugcaucu

SEQ ID NO: 7510 - RNA, 22 nt, Homo sapiens
gcgccgggaugccuugcaucug

SEQ ID NO: 7511 - RNA, 22 nt, Homo sapiens
cgccgggaugccuugcaucugc

SEQ ID NO: 7512 - RNA, 22 nt, Homo sapiens
gccgggaugccuugcaucugcc

SEQ ID NO: 7513 - RNA, 22 nt, Homo sapiens
ccgggaugccuugcaucugccc

SEQ ID NO: 7514 - RNA, 22 nt, Homo sapiens
cgggaugccuugcaucugcccc

SEQ ID NO: 7515 - RNA, 22 nt, Homo sapiens
gggaugccuugcaucugccccu

SEQ ID NO: 7516 - RNA, 22 nt, Homo sapiens
ggaugccuugcaucugccccug

SEQ ID NO: 7517 - RNA, 22 nt, Homo sapiens
gaugccuugcaucugccccugc

SEQ ID NO: 7518 - RNA, 22 nt, Homo sapiens
augccuugcaucugccccugcc

SEQ ID NO: 7519 - RNA, 22 nt, Homo sapiens
ugccuugcaucugccccugccg

SEQ ID NO: 7520 - RNA, 22 nt, Homo sapiens
gccuugcaucugccccugccgc

SEQ ID NO: 7521 - RNA, 22 nt, Homo sapiens
ccuugcaucugccccugccgcg

SEQ ID NO: 7522 - RNA, 22 nt, Homo sapiens
cuugcaucugccccugccgcgc

SEQ ID NO: 7523 - RNA, 22 nt, Homo sapiens
uugcaucugccccugccgcgcg

SEQ ID NO: 7524 - RNA, 22 nt, Homo sapiens
ugcaucugccccugccgcgcgg

SEQ ID NO: 7525 - RNA, 22 nt, Homo sapiens
gcaucugccccugccgcgcgga

SEQ ID NO: 7526 - RNA, 22 nt, Homo sapiens
caucugccccugccgcgcggag

SEQ ID NO: 7527 - RNA, 22 nt, Homo sapiens
aucugccccugccgcgcggagg

SEQ ID NO: 7528 - RNA, 22 nt, Homo sapiens
ucugccccugccgcgcggaggc

SEQ ID NO: 7529 - RNA, 22 nt, Homo sapiens
cugccccugccgcgcggaggcg

SEQ ID NO: 7530 - RNA, 22 nt, Homo sapiens
ugccccugccgcgcggaggcgg

SEQ ID NO: 7531 - RNA, 22 nt, Homo sapiens
gccccugccgcgcggaggcgga

SEQ ID NO: 7532 - RNA, 22 nt, Homo sapiens
ccccugccgcgcggaggcggag

SEQ ID NO: 7533 - RNA, 22 nt, Homo sapiens
cccugccgcgcggaggcggagg

SEQ ID NO: 7534 - RNA, 22 nt, Homo sapiens
ccugccgcgcggaggcggaggc

SEQ ID NO: 7535 - RNA, 22 nt, Homo sapiens
cugccgcgcggaggcggaggcg

SEQ ID NO: 7536 - RNA, 22 nt, Homo sapiens
ugccgcgcggaggcggaggcgu

SEQ ID NO: 7537 - RNA, 22 nt, Homo sapiens
gccgcgcggaggcggaggcguc

SEQ ID NO: 7538 - RNA, 22 nt, Homo sapiens
ccgcgcggaggcggaggcgucc

SEQ ID NO: 7539 - RNA, 22 nt, Homo sapiens
cgcgcggaggcggaggcguccg

SEQ ID NO: 7540 - RNA, 22 nt, Homo sapiens
gcgcggaggcggaggcguccgg

SEQ ID NO: 7541 - RNA, 22 nt, Homo sapiens
cgcggaggcggaggcguccggg

SEQ ID NO: 7542 - RNA, 22 nt, Homo sapiens
gcggaggcggaggcguccgggg

SEQ ID NO: 7543 - RNA, 22 nt, Homo sapiens
cggaggcggaggcguccggggg

SEQ ID NO: 7544 - RNA, 22 nt, Homo sapiens
ggaggcggaggcguccgggggc

SEQ ID NO: 7545 - RNA, 22 nt, Homo sapiens
gaggcggaggcguccgggggcg

SEQ ID NO: 7546 - RNA, 22 nt, Homo sapiens
aggcggaggcguccgggggcgc

SEQ ID NO: 7547 - RNA, 22 nt, Homo sapiens
ggcggaggcguccgggggcgcg

SEQ ID NO: 7548 - RNA, 22 nt, Homo sapiens
gcggaggcguccgggggcgcgg

SEQ ID NO: 7549 - RNA, 22 nt, Homo sapiens
cggaggcguccgggggcgcggg

SEQ ID NO: 7550 - RNA, 22 nt, Homo sapiens
ggaggcguccgggggcgcgggc

SEQ ID NO: 7551 - RNA, 22 nt, Homo sapiens
gaggcguccgggggcgcgggcu

SEQ ID NO: 7552 - RNA, 22 nt, Homo sapiens
aggcguccgggggcgcgggcug

SEQ ID NO: 7553 - RNA, 22 nt, Homo sapiens
ggcguccgggggcgcgggcugg

SEQ ID NO: 7554 - RNA, 22 nt, Homo sapiens
gcguccgggggcgcgggcuggg

SEQ ID NO: 7555 - RNA, 22 nt, Homo sapiens
cguccgggggcgcgggcugggg

SEQ ID NO: 7556 - RNA, 22 nt, Homo sapiens
guccgggggcgcgggcugggga

SEQ ID NO: 7557 - RNA, 22 nt, Homo sapiens
uccgggggcgcgggcuggggag

SEQ ID NO: 7558 - RNA, 22 nt, Homo sapiens
ccgggggcgcgggcuggggagg

SEQ ID NO: 7559 - RNA, 22 nt, Homo sapiens
cgggggcgcgggcuggggaggu

SEQ ID NO: 7560 - RNA, 22 nt, Homo sapiens
gggggcgcgggcuggggaggug

SEQ ID NO: 7561 - RNA, 22 nt, Homo sapiens
ggggcgcgggcuggggaggugg

SEQ ID NO: 7562 - RNA, 22 nt, Homo sapiens
gggcgcgggcuggggaggugga

SEQ ID NO: 7563 - RNA, 22 nt, Homo sapiens
ggcgcgggcuggggagguggag

SEQ ID NO: 7564 - RNA, 22 nt, Homo sapiens
gcgcgggcuggggagguggagc

SEQ ID NO: 7565 - RNA, 22 nt, Homo sapiens
cgcgggcuggggagguggagcu

SEQ ID NO: 7566 - RNA, 22 nt, Homo sapiens
gcgggcuggggagguggagcug

SEQ ID NO: 7567 - RNA, 22 nt, Homo sapiens
cgggcuggggagguggagcugc

SEQ ID NO: 7568 - RNA, 22 nt, Homo sapiens
gggcuggggagguggagcugcc

SEQ ID NO: 7569 - RNA, 22 nt, Homo sapiens
ggcuggggagguggagcugccc

SEQ ID NO: 7570 - RNA, 22 nt, Homo sapiens
gcuggggagguggagcugcccc

SEQ ID NO: 7571 - RNA, 22 nt, Homo sapiens
cuggggagguggagcugccccg

SEQ ID NO: 7572 - RNA, 22 nt, Homo sapiens
uggggagguggagcugccccgg

SEQ ID NO: 7573 - RNA, 22 nt, Homo sapiens
ggggagguggagcugccccggc

SEQ ID NO: 7574 - RNA, 22 nt, Homo sapiens
gggagguggagcugccccggcu

SEQ ID NO: 7575 - RNA, 22 nt, Homo sapiens
ggagguggagcugccccggcuu

SEQ ID NO: 7576 - RNA, 22 nt, Homo sapiens
gagguggagcugccccggcuug

SEQ ID NO: 7577 - RNA, 22 nt, Homo sapiens
agguggagcugccccggcuugg

SEQ ID NO: 7578 - RNA, 22 nt, Homo sapiens
gguggagcugccccggcuuggg

SEQ ID NO: 7579 - RNA, 22 nt, Homo sapiens
guggagcugccccggcuugggg

SEQ ID NO: 7580 - RNA, 22 nt, Homo sapiens
uggagcugccccggcuuggggu

SEQ ID NO: 7581 - RNA, 22 nt, Homo sapiens
ggagcugccccggcuugggguu

SEQ ID NO: 7582 - RNA, 22 nt, Homo sapiens
gagcugccccggcuugggguuc

SEQ ID NO: 7583 - RNA, 22 nt, Homo sapiens
agcugccccggcuugggguucc

SEQ ID NO: 7584 - RNA, 22 nt, Homo sapiens
gcugccccggcuugggguuccc

SEQ ID NO: 7585 - RNA, 22 nt, Homo sapiens
cugccccggcuugggguuccca

SEQ ID NO: 7586 - RNA, 22 nt, Homo sapiens
ugccccggcuugggguucccac

SEQ ID NO: 7587 - RNA, 22 nt, Homo sapiens
gccccggcuugggguucccacg

SEQ ID NO: 7588 - RNA, 22 nt, Homo sapiens
ccccggcuugggguucccacgc

SEQ ID NO: 7589 - RNA, 22 nt, Homo sapiens
cccggcuugggguucccacgcc

SEQ ID NO: 7590 - RNA, 22 nt, Homo sapiens
ccggcuugggguucccacgccg

SEQ ID NO: 7591 - RNA, 22 nt, Homo sapiens
cggcuugggguucccacgccgc

SEQ ID NO: 7592 - RNA, 22 nt, Homo sapiens
ggcuugggguucccacgccgcc

SEQ ID NO: 7593 - RNA, 22 nt, Homo sapiens
gcuugggguucccacgccgccc

SEQ ID NO: 7594 - RNA, 22 nt, Homo sapiens
cuugggguucccacgccgcccc

SEQ ID NO: 7595 - RNA, 22 nt, Homo sapiens
uugggguucccacgccgccccg

SEQ ID NO: 7596 - RNA, 22 nt, Homo sapiens
ugggguucccacgccgccccgg

SEQ ID NO: 7597 - RNA, 22 nt, Homo sapiens
gggguucccacgccgccccggc

SEQ ID NO: 7598 - RNA, 22 nt, Homo sapiens
ggguucccacgccgccccggcg

SEQ ID NO: 7599 - RNA, 22 nt, Homo sapiens
gguucccacgccgccccggcga

SEQ ID NO: 7600 - RNA, 22 nt, Homo sapiens
guucccacgccgccccggcgac

SEQ ID NO: 7601 - RNA, 22 nt, Homo sapiens
uucccacgccgccccggcgacc

SEQ ID NO: 7602 - RNA, 22 nt, Homo sapiens
ucccacgccgccccggcgaccu

SEQ ID NO: 7603 - RNA, 22 nt, Homo sapiens
cccacgccgccccggcgaccug

SEQ ID NO: 7604 - RNA, 22 nt, Homo sapiens
ccacgccgccccggcgaccugg

SEQ ID NO: 7605 - RNA, 22 nt, Homo sapiens
cacgccgccccggcgaccuggg

SEQ ID NO: 7606 - RNA, 22 nt, Homo sapiens
acgccgccccggcgaccugggg

SEQ ID NO: 7607 - RNA, 22 nt, Homo sapiens
cgccgccccggcgaccugggga

SEQ ID NO: 7608 - RNA, 22 nt, Homo sapiens
gccgccccggcgaccuggggac

SEQ ID NO: 7609 - RNA, 22 nt, Homo sapiens
ccgccccggcgaccuggggacc

SEQ ID NO: 7610 - RNA, 22 nt, Homo sapiens
cgccccggcgaccuggggaccc

SEQ ID NO: 7611 - RNA, 22 nt, Homo sapiens
gccccggcgaccuggggacccc

SEQ ID NO: 7612 - RNA, 22 nt, Homo sapiens
ccccggcgaccuggggaccccg

SEQ ID NO: 7613 - RNA, 22 nt, Homo sapiens
cccggcgaccuggggaccccgg

SEQ ID NO: 7614 - RNA, 22 nt, Homo sapiens
ccggcgaccuggggaccccggc

SEQ ID NO: 7615 - RNA, 22 nt, Homo sapiens
cggcgaccuggggaccccggcc

SEQ ID NO: 7616 - RNA, 22 nt, Homo sapiens
ggcgaccuggggaccccggccc

SEQ ID NO: 7617 - RNA, 22 nt, Homo sapiens
gcgaccuggggaccccggcccc

SEQ ID NO: 7618 - RNA, 22 nt, Homo sapiens
cgaccuggggaccccggcccca

SEQ ID NO: 7619 - RNA, 22 nt, Homo sapiens
gaccuggggaccccggccccag

SEQ ID NO: 7620 - RNA, 22 nt, Homo sapiens
accuggggaccccggccccagc

SEQ ID NO: 7621 - RNA, 22 nt, Homo sapiens
ccuggggaccccggccccagcc

SEQ ID NO: 7622 - RNA, 22 nt, Homo sapiens
cuggggaccccggccccagccc

SEQ ID NO: 7623 - RNA, 22 nt, Homo sapiens
uggggaccccggccccagcccc

SEQ ID NO: 7624 - RNA, 22 nt, Homo sapiens
ggggaccccggccccagcccca

SEQ ID NO: 7625 - RNA, 22 nt, Homo sapiens
gggaccccggccccagccccac

SEQ ID NO: 7626 - RNA, 22 nt, Homo sapiens
ggaccccggccccagccccacc

SEQ ID NO: 7627 - RNA, 22 nt, Homo sapiens
gaccccggccccagccccacca

SEQ ID NO: 7628 - RNA, 22 nt, Homo sapiens
accccggccccagccccaccac

SEQ ID NO: 7629 - RNA, 22 nt, Homo sapiens
ccccggccccagccccaccacg

SEQ ID NO: 7630 - RNA, 22 nt, Homo sapiens
cccggccccagccccaccacgg

SEQ ID NO: 7631 - RNA, 22 nt, Homo sapiens
ccggccccagccccaccacgga

SEQ ID NO: 7632 - RNA, 22 nt, Homo sapiens
cggccccagccccaccacggac

SEQ ID NO: 7633 - RNA, 22 nt, Homo sapiens
ggccccagccccaccacggacu

SEQ ID NO: 7634 - RNA, 22 nt, Homo sapiens
gccccagccccaccacggacuc

SEQ ID NO: 7635 - RNA, 22 nt, Homo sapiens
ccccagccccaccacggacucc

SEQ ID NO: 7636 - RNA, 22 nt, Homo sapiens
cccagccccaccacggacuccc

SEQ ID NO: 7637 - RNA, 22 nt, Homo sapiens
ccagccccaccacggacucccc

SEQ ID NO: 7638 - RNA, 22 nt, Homo sapiens
cagccccaccacggacuccccu

SEQ ID NO: 7639 - RNA, 22 nt, Homo sapiens
agccccaccacggacuccccug

SEQ ID NO: 7640 - RNA, 22 nt, Homo sapiens
gccccaccacggacuccccugg

SEQ ID NO: 7641 - RNA, 22 nt, Homo sapiens
ccccaccacggacuccccuggg

SEQ ID NO: 7642 - RNA, 22 nt, Homo sapiens
cccaccacggacuccccuggga

SEQ ID NO: 7643 - RNA, 22 nt, Homo sapiens
ccaccacggacuccccugggac

SEQ ID NO: 7644 - RNA, 22 nt, Homo sapiens
caccacggacuccccugggacg

SEQ ID NO: 7645 - RNA, 22 nt, Homo sapiens
accacggacuccccugggacgu

SEQ ID NO: 7646 - RNA, 22 nt, Homo sapiens
ccacggacuccccugggacgug

SEQ ID NO: 7647 - RNA, 22 nt, Homo sapiens
cacggacuccccugggacgugg

SEQ ID NO: 7648 - RNA, 22 nt, Homo sapiens
acggacuccccugggacguggg

SEQ ID NO: 7649 - RNA, 22 nt, Homo sapiens
cggacuccccugggacgugggu

SEQ ID NO: 7650 - RNA, 22 nt, Homo sapiens
ggacuccccugggacgugggug

SEQ ID NO: 7651 - RNA, 22 nt, Homo sapiens
gacuccccugggacgugggugg

SEQ ID NO: 7652 - RNA, 22 nt, Homo sapiens
acuccccugggacguggguggc

SEQ ID NO: 7653 - RNA, 22 nt, Homo sapiens
cuccccugggacguggguggcg

SEQ ID NO: 7654 - RNA, 22 nt, Homo sapiens
uccccugggacguggguggcgc

SEQ ID NO: 7655 - RNA, 22 nt, Homo sapiens
ccccugggacguggguggcgca

SEQ ID NO: 7656 - RNA, 22 nt, Homo sapiens
cccugggacguggguggcgcaa

SEQ ID NO: 7657 - RNA, 22 nt, Homo sapiens
ccugggacguggguggcgcaag

SEQ ID NO: 7658 - RNA, 22 nt, Homo sapiens
cugggacguggguggcgcaagc

SEQ ID NO: 7659 - RNA, 22 nt, Homo sapiens
ugggacguggguggcgcaagca

SEQ ID NO: 7660 - RNA, 22 nt, Homo sapiens
gggacguggguggcgcaagcac

SEQ ID NO: 7661 - RNA, 22 nt, Homo sapiens
ggacguggguggcgcaagcacc

SEQ ID NO: 7662 - RNA, 22 nt, Homo sapiens
gacguggguggcgcaagcaccc

SEQ ID NO: 7663 - RNA, 22 nt, Homo sapiens
acguggguggcgcaagcacccc

SEQ ID NO: 7664 - RNA, 22 nt, Homo sapiens
cguggguggcgcaagcaccccu

SEQ ID NO: 7665 - RNA, 22 nt, Homo sapiens
guggguggcgcaagcaccccuu

SEQ ID NO: 7666 - RNA, 22 nt, Homo sapiens
uggguggcgcaagcaccccuug

SEQ ID NO: 7667 - RNA, 22 nt, Homo sapiens
ggguggcgcaagcaccccuugg

SEQ ID NO: 7668 - RNA, 22 nt, Homo sapiens
gguggcgcaagcaccccuuggc

SEQ ID NO: 7669 - RNA, 22 nt, Homo sapiens
guggcgcaagcaccccuuggcc

SEQ ID NO: 7670 - RNA, 22 nt, Homo sapiens
uggcgcaagcaccccuuggccc

SEQ ID NO: 7671 - RNA, 22 nt, Homo sapiens
ggcgcaagcaccccuuggcccu

SEQ ID NO: 7672 - RNA, 22 nt, Homo sapiens
gcgcaagcaccccuuggcccug

SEQ ID NO: 7673 - RNA, 22 nt, Homo sapiens
cgcaagcaccccuuggcccugc

SEQ ID NO: 7674 - RNA, 22 nt, Homo sapiens
gcaagcaccccuuggcccugcg

SEQ ID NO: 7675 - RNA, 22 nt, Homo sapiens
caagcaccccuuggcccugcgg

SEQ ID NO: 7676 - RNA, 22 nt, Homo sapiens
aagcaccccuuggcccugcggc

SEQ ID NO: 7677 - RNA, 22 nt, Homo sapiens
agcaccccuuggcccugcggcc

SEQ ID NO: 7678 - RNA, 22 nt, Homo sapiens
gcaccccuuggcccugcggccc

SEQ ID NO: 7679 - RNA, 22 nt, Homo sapiens
caccccuuggcccugcggcccc

SEQ ID NO: 7680 - RNA, 22 nt, Homo sapiens
accccuuggcccugcggccccg

SEQ ID NO: 7681 - RNA, 22 nt, Homo sapiens
ccccuuggcccugcggccccgc

SEQ ID NO: 7682 - RNA, 22 nt, Homo sapiens
cccuuggcccugcggccccgcu

SEQ ID NO: 7683 - RNA, 22 nt, Homo sapiens
ccuuggcccugcggccccgcuu

SEQ ID NO: 7684 - RNA, 22 nt, Homo sapiens
cuuggcccugcggccccgcuug

SEQ ID NO: 7685 - RNA, 22 nt, Homo sapiens
uuggcccugcggccccgcuuga

SEQ ID NO: 7686 - RNA, 22 nt, Homo sapiens
uggcccugcggccccgcuugag

SEQ ID NO: 7687 - RNA, 22 nt, Homo sapiens
ggcccugcggccccgcuugagc

SEQ ID NO: 7688 - RNA, 22 nt, Homo sapiens
gcccugcggccccgcuugagcg

SEQ ID NO: 7689 - RNA, 22 nt, Homo sapiens
cccugcggccccgcuugagcgg

SEQ ID NO: 7690 - RNA, 22 nt, Homo sapiens
ccugcggccccgcuugagcggg

SEQ ID NO: 7691 - RNA, 22 nt, Homo sapiens
cugcggccccgcuugagcgggc

SEQ ID NO: 7692 - RNA, 22 nt, Homo sapiens
ugcggccccgcuugagcgggcc

SEQ ID NO: 7693 - RNA, 22 nt, Homo sapiens
gcggccccgcuugagcgggccc

SEQ ID NO: 7694 - RNA, 22 nt, Homo sapiens
cggccccgcuugagcgggccca

SEQ ID NO: 7695 - RNA, 22 nt, Homo sapiens
ggccccgcuugagcgggcccag

SEQ ID NO: 7696 - RNA, 22 nt, Homo sapiens
gccccgcuugagcgggcccagg

SEQ ID NO: 7697 - RNA, 22 nt, Homo sapiens
ccccgcuugagcgggcccaggc

SEQ ID NO: 7698 - RNA, 22 nt, Homo sapiens
cccgcuugagcgggcccaggcu

SEQ ID NO: 7699 - RNA, 22 nt, Homo sapiens
ccgcuugagcgggcccaggcug

SEQ ID NO: 7700 - RNA, 22 nt, Homo sapiens
cgcuugagcgggcccaggcugu

SEQ ID NO: 7701 - RNA, 22 nt, Homo sapiens
gcuugagcgggcccaggcugug

SEQ ID NO: 7702 - RNA, 22 nt, Homo sapiens
cuugagcgggcccaggcugugc

SEQ ID NO: 7703 - RNA, 22 nt, Homo sapiens
uugagcgggcccaggcugugcc

SEQ ID NO: 7704 - RNA, 22 nt, Homo sapiens
ugagcgggcccaggcugugcca

SEQ ID NO: 7705 - RNA, 22 nt, Homo sapiens
gagcgggcccaggcugugccac

SEQ ID NO: 7706 - RNA, 22 nt, Homo sapiens
agcgggcccaggcugugccacc

SEQ ID NO: 7707 - RNA, 22 nt, Homo sapiens
gcgggcccaggcugugccaccg

SEQ ID NO: 7708 - RNA, 22 nt, Homo sapiens
cgggcccaggcugugccaccgc

SEQ ID NO: 7709 - RNA, 22 nt, Homo sapiens
gggcccaggcugugccaccgcg

SEQ ID NO: 7710 - RNA, 22 nt, Homo sapiens
ggcccaggcugugccaccgcgc

SEQ ID NO: 7711 - RNA, 22 nt, Homo sapiens
gcccaggcugugccaccgcgca

SEQ ID NO: 7712 - RNA, 22 nt, Homo sapiens
cccaggcugugccaccgcgcag

SEQ ID NO: 7713 - RNA, 22 nt, Homo sapiens
ccaggcugugccaccgcgcagg

SEQ ID NO: 7714 - RNA, 22 nt, Homo sapiens
caggcugugccaccgcgcaggg

SEQ ID NO: 7715 - RNA, 22 nt, Homo sapiens
aggcugugccaccgcgcagggg

SEQ ID NO: 7716 - RNA, 22 nt, Homo sapiens
ggcugugccaccgcgcaggggc

SEQ ID NO: 7717 - RNA, 22 nt, Homo sapiens
gcugugccaccgcgcaggggcc

SEQ ID NO: 7718 - RNA, 22 nt, Homo sapiens
cugugccaccgcgcaggggccc

SEQ ID NO: 7719 - RNA, 22 nt, Homo sapiens
ugugccaccgcgcaggggcccg

SEQ ID NO: 7720 - RNA, 22 nt, Homo sapiens
gugccaccgcgcaggggcccgg

SEQ ID NO: 7721 - RNA, 22 nt, Homo sapiens
ugccaccgcgcaggggcccggc

SEQ ID NO: 7722 - RNA, 22 nt, Homo sapiens
gccaccgcgcaggggcccggca

SEQ ID NO: 7723 - RNA, 22 nt, Homo sapiens
ccaccgcgcaggggcccggcag

SEQ ID NO: 7724 - RNA, 22 nt, Homo sapiens
caccgcgcaggggcccggcagg

SEQ ID NO: 7725 - RNA, 22 nt, Homo sapiens
accgcgcaggggcccggcaggc

SEQ ID NO: 7726 - RNA, 22 nt, Homo sapiens
ccgcgcaggggcccggcaggcc

SEQ ID NO: 7727 - RNA, 22 nt, Homo sapiens
cgcgcaggggcccggcaggccg

SEQ ID NO: 7728 - RNA, 22 nt, Homo sapiens
gcgcaggggcccggcaggccgu

SEQ ID NO: 7729 - RNA, 22 nt, Homo sapiens
cgcaggggcccggcaggccguc

SEQ ID NO: 7730 - RNA, 22 nt, Homo sapiens
gcaggggcccggcaggccgucg

SEQ ID NO: 7731 - RNA, 22 nt, Homo sapiens
caggggcccggcaggccgucgc

SEQ ID NO: 7732 - RNA, 22 nt, Homo sapiens
aggggcccggcaggccgucgcg

SEQ ID NO: 7733 - RNA, 22 nt, Homo sapiens
ggggcccggcaggccgucgcgc

SEQ ID NO: 7734 - RNA, 22 nt, Homo sapiens
gggcccggcaggccgucgcgcu

SEQ ID NO: 7735 - RNA, 22 nt, Homo sapiens
ggcccggcaggccgucgcgcug

SEQ ID NO: 7736 - RNA, 22 nt, Homo sapiens
gcccggcaggccgucgcgcugc

SEQ ID NO: 7737 - RNA, 22 nt, Homo sapiens
cccggcaggccgucgcgcugcg

SEQ ID NO: 7738 - RNA, 22 nt, Homo sapiens
ccggcaggccgucgcgcugcgg

SEQ ID NO: 7739 - RNA, 22 nt, Homo sapiens
cggcaggccgucgcgcugcggg

SEQ ID NO: 7740 - RNA, 22 nt, Homo sapiens
ggcaggccgucgcgcugcgggu

SEQ ID NO: 7741 - RNA, 22 nt, Homo sapiens
gcaggccgucgcgcugcggguc

SEQ ID NO: 7742 - RNA, 22 nt, Homo sapiens
caggccgucgcgcugcgggucc

SEQ ID NO: 7743 - RNA, 22 nt, Homo sapiens
aggccgucgcgcugcggguccc

SEQ ID NO: 7744 - RNA, 22 nt, Homo sapiens
ggccgucgcgcugcgggucccg

SEQ ID NO: 7745 - RNA, 22 nt, Homo sapiens
gccgucgcgcugcgggucccgg

SEQ ID NO: 7746 - RNA, 22 nt, Homo sapiens
ccgucgcgcugcgggucccggu

SEQ ID NO: 7747 - RNA, 22 nt, Homo sapiens
cgucgcgcugcgggucccgguc

SEQ ID NO: 7748 - RNA, 22 nt, Homo sapiens
gucgcgcugcgggucccggucc

SEQ ID NO: 7749 - RNA, 22 nt, Homo sapiens
ucgcgcugcgggucccgguccu

SEQ ID NO: 7750 - RNA, 22 nt, Homo sapiens
cgcgcugcgggucccgguccuc

SEQ ID NO: 7751 - RNA, 22 nt, Homo sapiens
gcgcugcgggucccgguccucc

SEQ ID NO: 7752 - RNA, 22 nt, Homo sapiens
cgcugcgggucccgguccuccc

SEQ ID NO: 7753 - RNA, 22 nt, Homo sapiens
gcugcgggucccgguccucccg

SEQ ID NO: 7754 - RNA, 22 nt, Homo sapiens
cugcgggucccgguccucccgg

SEQ ID NO: 7755 - RNA, 22 nt, Homo sapiens
ugcgggucccgguccucccggc

SEQ ID NO: 7756 - RNA, 22 nt, Homo sapiens
gcgggucccgguccucccggcu

SEQ ID NO: 7757 - RNA, 22 nt, Homo sapiens
cgggucccgguccucccggcuu

SEQ ID NO: 7758 - RNA, 22 nt, Homo sapiens
gggucccgguccucccggcuuu

SEQ ID NO: 7759 - RNA, 22 nt, Homo sapiens
ggucccgguccucccggcuuuu

SEQ ID NO: 7760 - RNA, 22 nt, Homo sapiens
gucccgguccucccggcuuuug

SEQ ID NO: 7761 - RNA, 22 nt, Homo sapiens
ucccgguccucccggcuuuugc

SEQ ID NO: 7762 - RNA, 22 nt, Homo sapiens
cccgguccucccggcuuuugcc

SEQ ID NO: 7763 - RNA, 22 nt, Homo sapiens
ccgguccucccggcuuuugccc

SEQ ID NO: 7764 - RNA, 22 nt, Homo sapiens
cgguccucccggcuuuugcccg

SEQ ID NO: 7765 - RNA, 22 nt, Homo sapiens
gguccucccggcuuuugcccgg

SEQ ID NO: 7766 - RNA, 22 nt, Homo sapiens
guccucccggcuuuugcccggg

SEQ ID NO: 7767 - RNA, 22 nt, Homo sapiens
uccucccggcuuuugcccgggu

SEQ ID NO: 7768 - RNA, 22 nt, Homo sapiens
ccucccggcuuuugcccgggug

SEQ ID NO: 7769 - RNA, 22 nt, Homo sapiens
cucccggcuuuugcccgggugc

SEQ ID NO: 7770 - RNA, 22 nt, Homo sapiens
ucccggcuuuugcccgggugcg

SEQ ID NO: 7771 - RNA, 22 nt, Homo sapiens
cccggcuuuugcccgggugcgg

SEQ ID NO: 7772 - RNA, 22 nt, Homo sapiens
ccggcuuuugcccgggugcgga

SEQ ID NO: 7773 - RNA, 22 nt, Homo sapiens
cggcuuuugcccgggugcggag

SEQ ID NO: 7774 - RNA, 22 nt, Homo sapiens
ggcuuuugcccgggugcggagg

SEQ ID NO: 7775 - RNA, 22 nt, Homo sapiens
gcuuuugcccgggugcggaggc

SEQ ID NO: 7776 - RNA, 22 nt, Homo sapiens
cuuuugcccgggugcggaggcc

SEQ ID NO: 7777 - RNA, 22 nt, Homo sapiens
uuuugcccgggugcggaggcca

SEQ ID NO: 7778 - RNA, 22 nt, Homo sapiens
uuugcccgggugcggaggccag

SEQ ID NO: 7779 - RNA, 22 nt, Homo sapiens
uugcccgggugcggaggccagc

SEQ ID NO: 7780 - RNA, 22 nt, Homo sapiens
ugcccgggugcggaggccagcg

SEQ ID NO: 7781 - RNA, 22 nt, Homo sapiens
gcccgggugcggaggccagcga

SEQ ID NO: 7782 - RNA, 22 nt, Homo sapiens
cccgggugcggaggccagcgag

SEQ ID NO: 7783 - RNA, 22 nt, Homo sapiens
ccgggugcggaggccagcgagg

SEQ ID NO: 7784 - RNA, 22 nt, Homo sapiens
cgggugcggaggccagcgagga

SEQ ID NO: 7785 - RNA, 22 nt, Homo sapiens
gggugcggaggccagcgaggag

SEQ ID NO: 7786 - RNA, 22 nt, Homo sapiens
ggugcggaggccagcgaggagc

SEQ ID NO: 7787 - RNA, 22 nt, Homo sapiens
gugcggaggccagcgaggagcc

SEQ ID NO: 7788 - RNA, 22 nt, Homo sapiens
ugcggaggccagcgaggagccu

SEQ ID NO: 7789 - RNA, 22 nt, Homo sapiens
gcggaggccagcgaggagccug

SEQ ID NO: 7790 - RNA, 22 nt, Homo sapiens
cggaggccagcgaggagccuga

SEQ ID NO: 7791 - RNA, 22 nt, Homo sapiens
ggaggccagcgaggagccugag

SEQ ID NO: 7792 - RNA, 22 nt, Homo sapiens
gaggccagcgaggagccugagg

SEQ ID NO: 7793 - RNA, 22 nt, Homo sapiens
aggccagcgaggagccugaggg

SEQ ID NO: 7794 - RNA, 22 nt, Homo sapiens
ggccagcgaggagccugagggu

SEQ ID NO: 7795 - RNA, 22 nt, Homo sapiens
gccagcgaggagccugagggug

SEQ ID NO: 7796 - RNA, 22 nt, Homo sapiens
ccagcgaggagccugagggugg

SEQ ID NO: 7797 - RNA, 22 nt, Homo sapiens
cagcgaggagccugaggguggg

SEQ ID NO: 7798 - RNA, 22 nt, Homo sapiens
agcgaggagccugaggguggga

SEQ ID NO: 7799 - RNA, 22 nt, Homo sapiens
gcgaggagccugagggugggag

SEQ ID NO: 7800 - RNA, 22 nt, Homo sapiens
cgaggagccugagggugggaga

SEQ ID NO: 7801 - RNA, 22 nt, Homo sapiens
gaggagccugagggugggagag

SEQ ID NO: 7802 - RNA, 22 nt, Homo sapiens
aggagccugagggugggagagc

SEQ ID NO: 7803 - RNA, 22 nt, Homo sapiens
ggagccugagggugggagagcg

SEQ ID NO: 7804 - RNA, 22 nt, Homo sapiens
gagccugagggugggagagcgc

SEQ ID NO: 7805 - RNA, 22 nt, Homo sapiens
agccugagggugggagagcgcc

SEQ ID NO: 7806 - RNA, 22 nt, Homo sapiens
gccugagggugggagagcgccc

SEQ ID NO: 7807 - RNA, 22 nt, Homo sapiens
ccugagggugggagagcgcccc

SEQ ID NO: 7808 - RNA, 22 nt, Homo sapiens
cugagggugggagagcgccccg

SEQ ID NO: 7809 - RNA, 22 nt, Homo sapiens
ugagggugggagagcgccccgu

SEQ ID NO: 7810 - RNA, 22 nt, Homo sapiens
gagggugggagagcgccccguc

SEQ ID NO: 7811 - RNA, 22 nt, Homo sapiens
agggugggagagcgccccgucc

SEQ ID NO: 7812 - RNA, 22 nt, Homo sapiens
gggugggagagcgccccguccg

SEQ ID NO: 7813 - RNA, 22 nt, Homo sapiens
ggugggagagcgccccguccgg

SEQ ID NO: 7814 - RNA, 22 nt, Homo sapiens
gugggagagcgccccguccgga

SEQ ID NO: 7815 - RNA, 22 nt, Homo sapiens
ugggagagcgccccguccggag

SEQ ID NO: 7816 - RNA, 22 nt, Homo sapiens
gggagagcgccccguccggagg

SEQ ID NO: 7817 - RNA, 22 nt, Homo sapiens
ggagagcgccccguccggagga

SEQ ID NO: 7818 - RNA, 22 nt, Homo sapiens
gagagcgccccguccggaggag

SEQ ID NO: 7819 - RNA, 22 nt, Homo sapiens
agagcgccccguccggaggagc

SEQ ID NO: 7820 - RNA, 22 nt, Homo sapiens
gagcgccccguccggaggagcc

SEQ ID NO: 7821 - RNA, 22 nt, Homo sapiens
agcgccccguccggaggagccg

SEQ ID NO: 7822 - RNA, 22 nt, Homo sapiens
gcgccccguccggaggagccgg

SEQ ID NO: 7823 - RNA, 22 nt, Homo sapiens
cgccccguccggaggagccggg

SEQ ID NO: 7824 - RNA, 22 nt, Homo sapiens
gccccguccggaggagccgggg

SEQ ID NO: 7825 - RNA, 22 nt, Homo sapiens
ccccguccggaggagccggggc

SEQ ID NO: 7826 - RNA, 22 nt, Homo sapiens
cccguccggaggagccggggcg

SEQ ID NO: 7827 - RNA, 22 nt, Homo sapiens
ccguccggaggagccggggcgg

SEQ ID NO: 7828 - RNA, 22 nt, Homo sapiens
cguccggaggagccggggcggc

SEQ ID NO: 7829 - RNA, 22 nt, Homo sapiens
guccggaggagccggggcggcg

SEQ ID NO: 7830 - RNA, 22 nt, Homo sapiens
uccggaggagccggggcggcgu

SEQ ID NO: 7831 - RNA, 22 nt, Homo sapiens
ccggaggagccggggcggcgua

SEQ ID NO: 7832 - RNA, 22 nt, Homo sapiens
cggaggagccggggcggcguag

SEQ ID NO: 7833 - RNA, 22 nt, Homo sapiens
ggaggagccggggcggcguagg

SEQ ID NO: 7834 - RNA, 22 nt, Homo sapiens
gaggagccggggcggcguaggc

SEQ ID NO: 7835 - RNA, 22 nt, Homo sapiens
aggagccggggcggcguaggcg

SEQ ID NO: 7836 - RNA, 22 nt, Homo sapiens
ggagccggggcggcguaggcga

SEQ ID NO: 7837 - RNA, 22 nt, Homo sapiens
gagccggggcggcguaggcgaa

SEQ ID NO: 7838 - RNA, 22 nt, Homo sapiens
agccggggcggcguaggcgaaa

SEQ ID NO: 7839 - RNA, 22 nt, Homo sapiens
gccggggcggcguaggcgaaau

SEQ ID NO: 7840 - RNA, 22 nt, Homo sapiens
ccggggcggcguaggcgaaauc

SEQ ID NO: 7841 - RNA, 22 nt, Homo sapiens
cggggcggcguaggcgaaaucc

SEQ ID NO: 7842 - RNA, 22 nt, Homo sapiens
ggggcggcguaggcgaaauccc

SEQ ID NO: 7843 - RNA, 22 nt, Homo sapiens
gggcggcguaggcgaaaucccc

SEQ ID NO: 7844 - RNA, 22 nt, Homo sapiens
ggcggcguaggcgaaauccccg

SEQ ID NO: 7845 - RNA, 22 nt, Homo sapiens
gcggcguaggcgaaauccccgc

SEQ ID NO: 7846 - RNA, 22 nt, Homo sapiens
cggcguaggcgaaauccccgcg

SEQ ID NO: 7847 - RNA, 22 nt, Homo sapiens
ggcguaggcgaaauccccgcgc

SEQ ID NO: 7848 - RNA, 22 nt, Homo sapiens
gcguaggcgaaauccccgcgcg

SEQ ID NO: 7849 - RNA, 22 nt, Homo sapiens
cguaggcgaaauccccgcgcgc

SEQ ID NO: 7850 - RNA, 22 nt, Homo sapiens
guaggcgaaauccccgcgcgcc

SEQ ID NO: 7851 - RNA, 22 nt, Homo sapiens
uaggcgaaauccccgcgcgccg

SEQ ID NO: 7852 - RNA, 22 nt, Homo sapiens
aggcgaaauccccgcgcgccgg

SEQ ID NO: 7853 - RNA, 22 nt, Homo sapiens
ggcgaaauccccgcgcgccggg

SEQ ID NO: 7854 - RNA, 22 nt, Homo sapiens
gcgaaauccccgcgcgccgggg

SEQ ID NO: 7855 - RNA, 22 nt, Homo sapiens
cgaaauccccgcgcgccggggc

SEQ ID NO: 7856 - RNA, 22 nt, Homo sapiens
gaaauccccgcgcgccggggca

SEQ ID NO: 7857 - RNA, 22 nt, Homo sapiens
aaauccccgcgcgccggggcag

SEQ ID NO: 7858 - RNA, 22 nt, Homo sapiens
aauccccgcgcgccggggcagg

SEQ ID NO: 7859 - RNA, 22 nt, Homo sapiens
auccccgcgcgccggggcaggu

SEQ ID NO: 7860 - RNA, 22 nt, Homo sapiens
uccccgcgcgccggggcagguu

SEQ ID NO: 7861 - RNA, 22 nt, Homo sapiens
ccccgcgcgccggggcagguug

SEQ ID NO: 7862 - RNA, 22 nt, Homo sapiens
cccgcgcgccggggcagguugg

SEQ ID NO: 7863 - RNA, 22 nt, Homo sapiens
ccgcgcgccggggcagguuggg

SEQ ID NO: 7864 - RNA, 22 nt, Homo sapiens
cgcgcgccggggcagguuggga

SEQ ID NO: 7865 - RNA, 22 nt, Homo sapiens
gcgcgccggggcagguugggag

SEQ ID NO: 7866 - RNA, 22 nt, Homo sapiens
cgcgccggggcagguugggaga

SEQ ID NO: 7867 - RNA, 22 nt, Homo sapiens
gcgccggggcagguugggagau

SEQ ID NO: 7868 - RNA, 22 nt, Homo sapiens
cgccggggcagguugggagauc

SEQ ID NO: 7869 - RNA, 22 nt, Homo sapiens
gccggggcagguugggagaucc

SEQ ID NO: 7870 - RNA, 22 nt, Homo sapiens
ccggggcagguugggagauccc

SEQ ID NO: 7871 - RNA, 22 nt, Homo sapiens
cggggcagguugggagaucccc

SEQ ID NO: 7872 - RNA, 22 nt, Homo sapiens
ggggcagguugggagauccccu

SEQ ID NO: 7873 - RNA, 22 nt, Homo sapiens
gggcagguugggagauccccuc

SEQ ID NO: 7874 - RNA, 22 nt, Homo sapiens
ggcagguugggagauccccucu

SEQ ID NO: 7875 - RNA, 22 nt, Homo sapiens
gcagguugggagauccccucug

SEQ ID NO: 7876 - RNA, 22 nt, Homo sapiens
cagguugggagauccccucugc

SEQ ID NO: 7877 - RNA, 22 nt, Homo sapiens
agguugggagauccccucugcc

SEQ ID NO: 7878 - RNA, 22 nt, Homo sapiens
gguugggagauccccucugccg

SEQ ID NO: 7879 - RNA, 22 nt, Homo sapiens
guugggagauccccucugccgg

SEQ ID NO: 7880 - RNA, 22 nt, Homo sapiens
uugggagauccccucugccggc

SEQ ID NO: 7881 - RNA, 22 nt, Homo sapiens
ugggagauccccucugccggcg

SEQ ID NO: 7882 - RNA, 22 nt, Homo sapiens
gggagauccccucugccggcgc

SEQ ID NO: 7883 - RNA, 22 nt, Homo sapiens
ggagauccccucugccggcgcg

SEQ ID NO: 7884 - RNA, 22 nt, Homo sapiens
gagauccccucugccggcgcgg

SEQ ID NO: 7885 - RNA, 22 nt, Homo sapiens
agauccccucugccggcgcggc

SEQ ID NO: 7886 - RNA, 22 nt, Homo sapiens
gauccccucugccggcgcggcc

SEQ ID NO: 7887 - RNA, 22 nt, Homo sapiens
auccccucugccggcgcggccu

SEQ ID NO: 7888 - RNA, 22 nt, Homo sapiens
uccccucugccggcgcggccug

SEQ ID NO: 7889 - RNA, 22 nt, Homo sapiens
ccccucugccggcgcggccugg

SEQ ID NO: 7890 - RNA, 22 nt, Homo sapiens
cccucugccggcgcggccuggc

SEQ ID NO: 7891 - RNA, 22 nt, Homo sapiens
ccucugccggcgcggccuggcu

SEQ ID NO: 7892 - RNA, 22 nt, Homo sapiens
cucugccggcgcggccuggcug

SEQ ID NO: 7893 - RNA, 22 nt, Homo sapiens
ucugccggcgcggccuggcugg

SEQ ID NO: 7894 - RNA, 22 nt, Homo sapiens
cugccggcgcggccuggcuggg

SEQ ID NO: 7895 - RNA, 22 nt, Homo sapiens
ugccggcgcggccuggcugggc

SEQ ID NO: 7896 - RNA, 22 nt, Homo sapiens
gccggcgcggccuggcugggcu

SEQ ID NO: 7897 - RNA, 22 nt, Homo sapiens
ccggcgcggccuggcugggcug

SEQ ID NO: 7898 - RNA, 22 nt, Homo sapiens
cggcgcggccuggcugggcugc

SEQ ID NO: 7899 - RNA, 22 nt, Homo sapiens
ggcgcggccuggcugggcugca

SEQ ID NO: 7900 - RNA, 22 nt, Homo sapiens
gcgcggccuggcugggcugcag

SEQ ID NO: 7901 - RNA, 22 nt, Homo sapiens
cgcggccuggcugggcugcagc

SEQ ID NO: 7902 - RNA, 22 nt, Homo sapiens
gcggccuggcugggcugcagcg

SEQ ID NO: 7903 - RNA, 22 nt, Homo sapiens
cggccuggcugggcugcagcgc

SEQ ID NO: 7904 - RNA, 22 nt, Homo sapiens
ggccuggcugggcugcagcgcg

SEQ ID NO: 7905 - RNA, 22 nt, Homo sapiens
gccuggcugggcugcagcgcgg

SEQ ID NO: 7906 - RNA, 22 nt, Homo sapiens
ccuggcugggcugcagcgcggg

SEQ ID NO: 7907 - RNA, 22 nt, Homo sapiens
cuggcugggcugcagcgcgggg

SEQ ID NO: 7908 - RNA, 22 nt, Homo sapiens
uggcugggcugcagcgcggggg

SEQ ID NO: 7909 - RNA, 22 nt, Homo sapiens
ggcugggcugcagcgcgggggc

SEQ ID NO: 7910 - RNA, 22 nt, Homo sapiens
gcugggcugcagcgcgggggcg

SEQ ID NO: 7911 - RNA, 22 nt, Homo sapiens
cugggcugcagcgcgggggcgg

SEQ ID NO: 7912 - RNA, 22 nt, Homo sapiens
ugggcugcagcgcgggggcggc

SEQ ID NO: 7913 - RNA, 22 nt, Homo sapiens
gggcugcagcgcgggggcggcc

SEQ ID NO: 7914 - RNA, 22 nt, Homo sapiens
ggcugcagcgcgggggcggccc

SEQ ID NO: 7915 - RNA, 22 nt, Homo sapiens
gcugcagcgcgggggcggcccu

SEQ ID NO: 7916 - RNA, 22 nt, Homo sapiens
cugcagcgcgggggcggcccuc

SEQ ID NO: 7917 - RNA, 22 nt, Homo sapiens
ugcagcgcgggggcggcccucg

SEQ ID NO: 7918 - RNA, 22 nt, Homo sapiens
gcagcgcgggggcggcccucgc

SEQ ID NO: 7919 - RNA, 22 nt, Homo sapiens
cagcgcgggggcggcccucgcu

SEQ ID NO: 7920 - RNA, 22 nt, Homo sapiens
agcgcgggggcggcccucgcug

SEQ ID NO: 7921 - RNA, 22 nt, Homo sapiens
gcgcgggggcggcccucgcugc

SEQ ID NO: 7922 - RNA, 22 nt, Homo sapiens
cgcgggggcggcccucgcugcc

SEQ ID NO: 7923 - RNA, 22 nt, Homo sapiens
gcgggggcggcccucgcugccu

SEQ ID NO: 7924 - RNA, 22 nt, Homo sapiens
cgggggcggcccucgcugccug

SEQ ID NO: 7925 - RNA, 22 nt, Homo sapiens
gggggcggcccucgcugccugg

SEQ ID NO: 7926 - RNA, 22 nt, Homo sapiens
ggggcggcccucgcugccuggc

SEQ ID NO: 7927 - RNA, 22 nt, Homo sapiens
gggcggcccucgcugccuggcu

SEQ ID NO: 7928 - RNA, 22 nt, Homo sapiens
ggcggcccucgcugccuggcuc

SEQ ID NO: 7929 - RNA, 22 nt, Homo sapiens
gcggcccucgcugccuggcuca

SEQ ID NO: 7930 - RNA, 22 nt, Homo sapiens
cggcccucgcugccuggcucac

SEQ ID NO: 7931 - RNA, 22 nt, Homo sapiens
ggcccucgcugccuggcucacg

SEQ ID NO: 7932 - RNA, 22 nt, Homo sapiens
gcccucgcugccuggcucacga

SEQ ID NO: 7933 - RNA, 22 nt, Homo sapiens
cccucgcugccuggcucacgaa

SEQ ID NO: 7934 - RNA, 22 nt, Homo sapiens
ccucgcugccuggcucacgaaa

SEQ ID NO: 7935 - RNA, 22 nt, Homo sapiens
cucgcugccuggcucacgaaag

SEQ ID NO: 7936 - RNA, 22 nt, Homo sapiens
ucgcugccuggcucacgaaagc

SEQ ID NO: 7937 - RNA, 22 nt, Homo sapiens
cgcugccuggcucacgaaagcc

SEQ ID NO: 7938 - RNA, 22 nt, Homo sapiens
gcugccuggcucacgaaagccc

SEQ ID NO: 7939 - RNA, 22 nt, Homo sapiens
cugccuggcucacgaaagcccc

SEQ ID NO: 7940 - RNA, 22 nt, Homo sapiens
ugccuggcucacgaaagccccc

SEQ ID NO: 7941 - RNA, 22 nt, Homo sapiens
gccuggcucacgaaagcccccu

SEQ ID NO: 7942 - RNA, 22 nt, Homo sapiens
ccuggcucacgaaagcccccug

SEQ ID NO: 7943 - RNA, 22 nt, Homo sapiens
cuggcucacgaaagcccccugu

SEQ ID NO: 7944 - RNA, 22 nt, Homo sapiens
uggcucacgaaagcccccugug

SEQ ID NO: 7945 - RNA, 22 nt, Homo sapiens
ggcucacgaaagcccccugugg

SEQ ID NO: 7946 - RNA, 22 nt, Homo sapiens
gcucacgaaagcccccuguggg

SEQ ID NO: 7947 - RNA, 22 nt, Homo sapiens
cucacgaaagcccccuguggga

SEQ ID NO: 7948 - RNA, 22 nt, Homo sapiens
ucacgaaagcccccugugggag

SEQ ID NO: 7949 - RNA, 22 nt, Homo sapiens
cacgaaagcccccugugggaga

SEQ ID NO: 7950 - RNA, 22 nt, Homo sapiens
acgaaagcccccugugggagag

SEQ ID NO: 7951 - RNA, 22 nt, Homo sapiens
cgaaagcccccugugggagagc

SEQ ID NO: 7952 - RNA, 22 nt, Homo sapiens
gaaagcccccugugggagagcc

SEQ ID NO: 7953 - RNA, 22 nt, Homo sapiens
aaagcccccugugggagagccc

SEQ ID NO: 7954 - RNA, 22 nt, Homo sapiens
aagcccccugugggagagcccc

SEQ ID NO: 7955 - RNA, 22 nt, Homo sapiens
agcccccugugggagagcccca

SEQ ID NO: 7956 - RNA, 22 nt, Homo sapiens
gcccccugugggagagccccag

SEQ ID NO: 7957 - RNA, 22 nt, Homo sapiens
cccccugugggagagccccagg

SEQ ID NO: 7958 - RNA, 22 nt, Homo sapiens
ccccugugggagagccccaggc

SEQ ID NO: 7959 - RNA, 22 nt, Homo sapiens
cccugugggagagccccaggcg

SEQ ID NO: 7960 - RNA, 22 nt, Homo sapiens
ccugugggagagccccaggcgc

SEQ ID NO: 7961 - RNA, 22 nt, Homo sapiens
cugugggagagccccaggcgcg

SEQ ID NO: 7962 - RNA, 22 nt, Homo sapiens
ugugggagagccccaggcgcgc

SEQ ID NO: 7963 - RNA, 22 nt, Homo sapiens
gugggagagccccaggcgcgca

SEQ ID NO: 7964 - RNA, 22 nt, Homo sapiens
ugggagagccccaggcgcgcag

SEQ ID NO: 7965 - RNA, 22 nt, Homo sapiens
gggagagccccaggcgcgcagg

SEQ ID NO: 7966 - RNA, 22 nt, Homo sapiens
ggagagccccaggcgcgcaggg

SEQ ID NO: 7967 - RNA, 22 nt, Homo sapiens
gagagccccaggcgcgcagggc

SEQ ID NO: 7968 - RNA, 22 nt, Homo sapiens
agagccccaggcgcgcagggca

SEQ ID NO: 7969 - RNA, 22 nt, Homo sapiens
gagccccaggcgcgcagggcac

SEQ ID NO: 7970 - RNA, 22 nt, Homo sapiens
agccccaggcgcgcagggcacg

SEQ ID NO: 7971 - RNA, 22 nt, Homo sapiens
gccccaggcgcgcagggcacgu

SEQ ID NO: 7972 - RNA, 22 nt, Homo sapiens
ccccaggcgcgcagggcacgug

SEQ ID NO: 7973 - RNA, 22 nt, Homo sapiens
cccaggcgcgcagggcacgugg

SEQ ID NO: 7974 - RNA, 22 nt, Homo sapiens
ccaggcgcgcagggcacguggg

SEQ ID NO: 7975 - RNA, 22 nt, Homo sapiens
caggcgcgcagggcacgugggg

SEQ ID NO: 7976 - RNA, 22 nt, Homo sapiens
aggcgcgcagggcacguggggu

SEQ ID NO: 7977 - RNA, 22 nt, Homo sapiens
ggcgcgcagggcacguggggug

SEQ ID NO: 7978 - RNA, 22 nt, Homo sapiens
gcgcgcagggcacguggggugc

SEQ ID NO: 7979 - RNA, 22 nt, Homo sapiens
cgcgcagggcacguggggugcg

SEQ ID NO: 7980 - RNA, 22 nt, Homo sapiens
gcgcagggcacguggggugcgg

SEQ ID NO: 7981 - RNA, 22 nt, Homo sapiens
cgcagggcacguggggugcggg

SEQ ID NO: 7982 - RNA, 22 nt, Homo sapiens
gcagggcacguggggugcggga

SEQ ID NO: 7983 - RNA, 22 nt, Homo sapiens
cagggcacguggggugcgggaa

SEQ ID NO: 7984 - RNA, 22 nt, Homo sapiens
agggcacguggggugcgggaag

SEQ ID NO: 7985 - RNA, 22 nt, Homo sapiens
gggcacguggggugcgggaagc

SEQ ID NO: 7986 - RNA, 22 nt, Homo sapiens
ggcacguggggugcgggaagcc

SEQ ID NO: 7987 - RNA, 22 nt, Homo sapiens
gcacguggggugcgggaagccc

SEQ ID NO: 7988 - RNA, 22 nt, Homo sapiens
cacguggggugcgggaagcccc

SEQ ID NO: 7989 - RNA, 22 nt, Homo sapiens
acguggggugcgggaagccccg

SEQ ID NO: 7990 - RNA, 22 nt, Homo sapiens
cguggggugcgggaagccccgu

SEQ ID NO: 7991 - RNA, 22 nt, Homo sapiens
guggggugcgggaagccccguu

SEQ ID NO: 7992 - RNA, 22 nt, Homo sapiens
uggggugcgggaagccccguuc

SEQ ID NO: 7993 - RNA, 22 nt, Homo sapiens
ggggugcgggaagccccguucc

SEQ ID NO: 7994 - RNA, 22 nt, Homo sapiens
gggugcgggaagccccguuccc

SEQ ID NO: 7995 - RNA, 22 nt, Homo sapiens
ggugcgggaagccccguucccc

SEQ ID NO: 7996 - RNA, 22 nt, Homo sapiens
gugcgggaagccccguucccca

SEQ ID NO: 7997 - RNA, 22 nt, Homo sapiens
ugcgggaagccccguuccccac

SEQ ID NO: 7998 - RNA, 22 nt, Homo sapiens
gcgggaagccccguuccccacg

SEQ ID NO: 7999 - RNA, 22 nt, Homo sapiens
cgggaagccccguuccccacgc

SEQ ID NO: 8000 - RNA, 22 nt, Homo sapiens
gggaagccccguuccccacgcg

SEQ ID NO: 8001 - RNA, 22 nt, Homo sapiens
ggaagccccguuccccacgcgc

SEQ ID NO: 8002 - RNA, 22 nt, Homo sapiens
gaagccccguuccccacgcgcc

SEQ ID NO: 8003 - RNA, 22 nt, Homo sapiens
aagccccguuccccacgcgccg

SEQ ID NO: 8004 - RNA, 22 nt, Homo sapiens
agccccguuccccacgcgccgg

SEQ ID NO: 8005 - RNA, 22 nt, Homo sapiens
gccccguuccccacgcgccggu

SEQ ID NO: 8006 - RNA, 22 nt, Homo sapiens
ccccguuccccacgcgccggug

SEQ ID NO: 8007 - RNA, 22 nt, Homo sapiens
cccguuccccacgcgccggugu

SEQ ID NO: 8008 - RNA, 22 nt, Homo sapiens
ccguuccccacgcgccggugug

SEQ ID NO: 8009 - RNA, 22 nt, Homo sapiens
cguuccccacgcgccggugugg

SEQ ID NO: 8010 - RNA, 22 nt, Homo sapiens
guuccccacgcgccgguguggg

SEQ ID NO: 8011 - RNA, 22 nt, Homo sapiens
uuccccacgcgccggugugggc

SEQ ID NO: 8012 - RNA, 22 nt, Homo sapiens
uccccacgcgccggugugggcg

SEQ ID NO: 8013 - RNA, 22 nt, Homo sapiens
ccccacgcgccggugugggcga

SEQ ID NO: 8014 - RNA, 22 nt, Homo sapiens
cccacgcgccggugugggcgaa

SEQ ID NO: 8015 - RNA, 22 nt, Homo sapiens
ccacgcgccggugugggcgaag

SEQ ID NO: 8016 - RNA, 22 nt, Homo sapiens
cacgcgccggugugggcgaagg

SEQ ID NO: 8017 - RNA, 22 nt, Homo sapiens
acgcgccggugugggcgaaggc

SEQ ID NO: 8018 - RNA, 22 nt, Homo sapiens
cgcgccggugugggcgaaggcg

SEQ ID NO: 8019 - RNA, 22 nt, Homo sapiens
gcgccggugugggcgaaggcga

SEQ ID NO: 8020 - RNA, 22 nt, Homo sapiens
cgccggugugggcgaaggcgac

SEQ ID NO: 8021 - RNA, 22 nt, Homo sapiens
gccggugugggcgaaggcgacc

SEQ ID NO: 8022 - RNA, 22 nt, Homo sapiens
ccggugugggcgaaggcgaccc

SEQ ID NO: 8023 - RNA, 22 nt, Homo sapiens
cggugugggcgaaggcgaccca

SEQ ID NO: 8024 - RNA, 22 nt, Homo sapiens
ggugugggcgaaggcgacccac

SEQ ID NO: 8025 - RNA, 22 nt, Homo sapiens
gugugggcgaaggcgacccacg

SEQ ID NO: 8026 - RNA, 22 nt, Homo sapiens
ugugggcgaaggcgacccacga

SEQ ID NO: 8027 - RNA, 22 nt, Homo sapiens
gugggcgaaggcgacccacgag

SEQ ID NO: 8028 - RNA, 22 nt, Homo sapiens
ugggcgaaggcgacccacgagg

SEQ ID NO: 8029 - RNA, 22 nt, Homo sapiens
gggcgaaggcgacccacgaggg

SEQ ID NO: 8030 - RNA, 22 nt, Homo sapiens
ggcgaaggcgacccacgaggga

SEQ ID NO: 8031 - RNA, 22 nt, Homo sapiens
gcgaaggcgacccacgagggag

SEQ ID NO: 8032 - RNA, 22 nt, Homo sapiens
cgaaggcgacccacgagggagc

SEQ ID NO: 8033 - RNA, 22 nt, Homo sapiens
gaaggcgacccacgagggagca

SEQ ID NO: 8034 - RNA, 22 nt, Homo sapiens
aaggcgacccacgagggagcag

SEQ ID NO: 8035 - RNA, 22 nt, Homo sapiens
aggcgacccacgagggagcagg

SEQ ID NO: 8036 - RNA, 22 nt, Homo sapiens
ggcgacccacgagggagcaggg

SEQ ID NO: 8037 - RNA, 22 nt, Homo sapiens
gcgacccacgagggagcagggu

SEQ ID NO: 8038 - RNA, 22 nt, Homo sapiens
cgacccacgagggagcagggug

SEQ ID NO: 8039 - RNA, 22 nt, Homo sapiens
gacccacgagggagcaggguga

SEQ ID NO: 8040 - RNA, 22 nt, Homo sapiens
acccacgagggagcagggugac

SEQ ID NO: 8041 - RNA, 22 nt, Homo sapiens
cccacgagggagcagggugacc

SEQ ID NO: 8042 - RNA, 22 nt, Homo sapiens
ccacgagggagcagggugaccc

SEQ ID NO: 8043 - RNA, 22 nt, Homo sapiens
cacgagggagcagggugacccc

SEQ ID NO: 8044 - RNA, 22 nt, Homo sapiens
acgagggagcagggugaccccc

SEQ ID NO: 8045 - RNA, 22 nt, Homo sapiens
cgagggagcagggugacccccg

SEQ ID NO: 8046 - RNA, 22 nt, Homo sapiens
gagggagcagggugacccccgc

SEQ ID NO: 8047 - RNA, 22 nt, Homo sapiens
agggagcagggugacccccgcc

SEQ ID NO: 8048 - RNA, 22 nt, Homo sapiens
gggagcagggugacccccgccg

SEQ ID NO: 8049 - RNA, 22 nt, Homo sapiens
ggagcagggugacccccgccgg

SEQ ID NO: 8050 - RNA, 22 nt, Homo sapiens
gagcagggugacccccgccggg

SEQ ID NO: 8051 - RNA, 22 nt, Homo sapiens
agcagggugacccccgccgggg

SEQ ID NO: 8052 - RNA, 22 nt, Homo sapiens
gcagggugacccccgccggggg

SEQ ID NO: 8053 - RNA, 22 nt, Homo sapiens
cagggugacccccgccgggggc

SEQ ID NO: 8054 - RNA, 22 nt, Homo sapiens
agggugacccccgccgggggcc

SEQ ID NO: 8055 - RNA, 22 nt, Homo sapiens
gggugacccccgccgggggccg

SEQ ID NO: 8056 - RNA, 22 nt, Homo sapiens
ggugacccccgccgggggccgc

SEQ ID NO: 8057 - RNA, 22 nt, Homo sapiens
gugacccccgccgggggccgcg

SEQ ID NO: 8058 - RNA, 22 nt, Homo sapiens
ugacccccgccgggggccgcgc

SEQ ID NO: 8059 - RNA, 22 nt, Homo sapiens
gacccccgccgggggccgcgcu

SEQ ID NO: 8060 - RNA, 22 nt, Homo sapiens
acccccgccgggggccgcgcug

SEQ ID NO: 8061 - RNA, 22 nt, Homo sapiens
cccccgccgggggccgcgcugc

SEQ ID NO: 8062 - RNA, 22 nt, Homo sapiens
ccccgccgggggccgcgcugca

SEQ ID NO: 8063 - RNA, 22 nt, Homo sapiens
cccgccgggggccgcgcugcac

SEQ ID NO: 8064 - RNA, 22 nt, Homo sapiens
ccgccgggggccgcgcugcaca

SEQ ID NO: 8065 - RNA, 22 nt, Homo sapiens
cgccgggggccgcgcugcacag

SEQ ID NO: 8066 - RNA, 22 nt, Homo sapiens
gccgggggccgcgcugcacagg

SEQ ID NO: 8067 - RNA, 22 nt, Homo sapiens
ccgggggccgcgcugcacaggc

SEQ ID NO: 8068 - RNA, 22 nt, Homo sapiens
cgggggccgcgcugcacaggcc

SEQ ID NO: 8069 - RNA, 22 nt, Homo sapiens
gggggccgcgcugcacaggccg

SEQ ID NO: 8070 - RNA, 22 nt, Homo sapiens
ggggccgcgcugcacaggccgc

SEQ ID NO: 8071 - RNA, 22 nt, Homo sapiens
gggccgcgcugcacaggccgcc

SEQ ID NO: 8072 - RNA, 22 nt, Homo sapiens
ggccgcgcugcacaggccgccu

SEQ ID NO: 8073 - RNA, 22 nt, Homo sapiens
gccgcgcugcacaggccgccug

SEQ ID NO: 8074 - RNA, 22 nt, Homo sapiens
ccgcgcugcacaggccgccugc

SEQ ID NO: 8075 - RNA, 22 nt, Homo sapiens
cgcgcugcacaggccgccugcc

SEQ ID NO: 8076 - RNA, 22 nt, Homo sapiens
gcgcugcacaggccgccugccu

SEQ ID NO: 8077 - RNA, 22 nt, Homo sapiens
cgcugcacaggccgccugccug

SEQ ID NO: 8078 - RNA, 22 nt, Homo sapiens
gcugcacaggccgccugccugc

SEQ ID NO: 8079 - RNA, 22 nt, Homo sapiens
cugcacaggccgccugccugcg

SEQ ID NO: 8080 - RNA, 22 nt, Homo sapiens
ugcacaggccgccugccugcgc

SEQ ID NO: 8081 - RNA, 22 nt, Homo sapiens
gcacaggccgccugccugcgcg

SEQ ID NO: 8082 - RNA, 22 nt, Homo sapiens
cacaggccgccugccugcgcgg

SEQ ID NO: 8083 - RNA, 22 nt, Homo sapiens
acaggccgccugccugcgcggg

SEQ ID NO: 8084 - RNA, 22 nt, Homo sapiens
caggccgccugccugcgcgggc

SEQ ID NO: 8085 - RNA, 22 nt, Homo sapiens
aggccgccugccugcgcgggcg

SEQ ID NO: 8086 - RNA, 22 nt, Homo sapiens
ggccgccugccugcgcgggcgc

SEQ ID NO: 8087 - RNA, 22 nt, Homo sapiens
gccgccugccugcgcgggcgcc

SEQ ID NO: 8088 - RNA, 22 nt, Homo sapiens
ccgccugccugcgcgggcgccc

SEQ ID NO: 8089 - RNA, 22 nt, Homo sapiens
cgccugccugcgcgggcgcccu

SEQ ID NO: 8090 - RNA, 22 nt, Homo sapiens
gccugccugcgcgggcgcccug

SEQ ID NO: 8091 - RNA, 22 nt, Homo sapiens
ccugccugcgcgggcgcccugc

SEQ ID NO: 8092 - RNA, 22 nt, Homo sapiens
cugccugcgcgggcgcccugcc

SEQ ID NO: 8093 - RNA, 22 nt, Homo sapiens
ugccugcgcgggcgcccugcca

SEQ ID NO: 8094 - RNA, 22 nt, Homo sapiens
gccugcgcgggcgcccugccac

SEQ ID NO: 8095 - RNA, 22 nt, Homo sapiens
ccugcgcgggcgcccugccacc

SEQ ID NO: 8096 - RNA, 22 nt, Homo sapiens
cugcgcgggcgcccugccaccc

SEQ ID NO: 8097 - RNA, 22 nt, Homo sapiens
ugcgcgggcgcccugccacccu

SEQ ID NO: 8098 - RNA, 22 nt, Homo sapiens
gcgcgggcgcccugccacccug

SEQ ID NO: 8099 - RNA, 22 nt, Homo sapiens
cgcgggcgcccugccacccugu

SEQ ID NO: 8100 - RNA, 22 nt, Homo sapiens
gcgggcgcccugccacccuguc

SEQ ID NO: 8101 - RNA, 22 nt, Homo sapiens
cgggcgcccugccacccugucc

SEQ ID NO: 8102 - RNA, 22 nt, Homo sapiens
gggcgcccugccacccuguccc

SEQ ID NO: 8103 - RNA, 22 nt, Homo sapiens
ggcgcccugccacccugucccg

SEQ ID NO: 8104 - RNA, 22 nt, Homo sapiens
gcgcccugccacccugucccgg

SEQ ID NO: 8105 - RNA, 22 nt, Homo sapiens
cgcccugccacccugucccggg

SEQ ID NO: 8106 - RNA, 22 nt, Homo sapiens
gcccugccacccugucccgggu

SEQ ID NO: 8107 - RNA, 22 nt, Homo sapiens
cccugccacccugucccgggug

SEQ ID NO: 8108 - RNA, 22 nt, Homo sapiens
ccugccacccugucccgggugc

SEQ ID NO: 8109 - RNA, 22 nt, Homo sapiens
cugccacccugucccgggugcc

SEQ ID NO: 8110 - RNA, 22 nt, Homo sapiens
ugccacccugucccgggugccu

SEQ ID NO: 8111 - RNA, 22 nt, Homo sapiens
gccacccugucccgggugccug

SEQ ID NO: 8112 - RNA, 22 nt, Homo sapiens
ccacccugucccgggugccugg

SEQ ID NO: 8113 - RNA, 22 nt, Homo sapiens
cacccugucccgggugccuggc

SEQ ID NO: 8114 - RNA, 22 nt, Homo sapiens
acccugucccgggugccuggcc

SEQ ID NO: 8115 - RNA, 22 nt, Homo sapiens
cccugucccgggugccuggccc

SEQ ID NO: 8116 - RNA, 22 nt, Homo sapiens
ccugucccgggugccuggcccu

SEQ ID NO: 8117 - RNA, 22 nt, Homo sapiens
cugucccgggugccuggcccuu

SEQ ID NO: 8118 - RNA, 22 nt, Homo sapiens
ugucccgggugccuggcccuuc

SEQ ID NO: 8119 - RNA, 22 nt, Homo sapiens
gucccgggugccuggcccuucg

SEQ ID NO: 8120 - RNA, 22 nt, Homo sapiens
ucccgggugccuggcccuucga

SEQ ID NO: 8121 - RNA, 22 nt, Homo sapiens
cccgggugccuggcccuucgau

SEQ ID NO: 8122 - RNA, 22 nt, Homo sapiens
ccgggugccuggcccuucgauu

SEQ ID NO: 8123 - RNA, 22 nt, Homo sapiens
cgggugccuggcccuucgauuc

SEQ ID NO: 8124 - RNA, 22 nt, Homo sapiens
gggugccuggcccuucgauucu

SEQ ID NO: 8125 - RNA, 22 nt, Homo sapiens
ggugccuggcccuucgauucug

SEQ ID NO: 8126 - RNA, 22 nt, Homo sapiens
gugccuggcccuucgauucuga

SEQ ID NO: 8127 - RNA, 22 nt, Homo sapiens
ugccuggcccuucgauucugaa

SEQ ID NO: 8128 - RNA, 22 nt, Homo sapiens
gccuggcccuucgauucugaaa

SEQ ID NO: 8129 - RNA, 22 nt, Homo sapiens
ccuggcccuucgauucugaaac

SEQ ID NO: 8130 - RNA, 22 nt, Homo sapiens
cuggcccuucgauucugaaacc

SEQ ID NO: 8131 - RNA, 22 nt, Homo sapiens
uggcccuucgauucugaaacca

SEQ ID NO: 8132 - RNA, 22 nt, Homo sapiens
ggcccuucgauucugaaaccag

SEQ ID NO: 8133 - RNA, 22 nt, Homo sapiens
gcccuucgauucugaaaccaga

SEQ ID NO: 8134 - RNA, 22 nt, Homo sapiens
cccuucgauucugaaaccagau

SEQ ID NO: 8135 - RNA, 22 nt, Homo sapiens
ccuucgauucugaaaccagauc

SEQ ID NO: 8136 - RNA, 22 nt, Homo sapiens
cuucgauucugaaaccagaucu

SEQ ID NO: 8137 - RNA, 22 nt, Homo sapiens
uucgauucugaaaccagaucug

SEQ ID NO: 8138 - RNA, 22 nt, Homo sapiens
ucgauucugaaaccagaucuga

SEQ ID NO: 8139 - RNA, 22 nt, Homo sapiens
cgauucugaaaccagaucugaa

SEQ ID NO: 8140 - RNA, 22 nt, Homo sapiens
gauucugaaaccagaucugaau

SEQ ID NO: 8141 - RNA, 22 nt, Homo sapiens
auucugaaaccagaucugaauc

SEQ ID NO: 8142 - RNA, 22 nt, Homo sapiens
uucugaaaccagaucugaaucc

SEQ ID NO: 8143 - RNA, 22 nt, Homo sapiens
ucugaaaccagaucugaauccu

SEQ ID NO: 8144 - RNA, 22 nt, Homo sapiens
cugaaaccagaucugaauccug

SEQ ID NO: 8145 - RNA, 22 nt, Homo sapiens
ugaaaccagaucugaauccugg

SEQ ID NO: 8146 - RNA, 22 nt, Homo sapiens
gaaaccagaucugaauccugga

SEQ ID NO: 8147 - RNA, 22 nt, Homo sapiens
aaaccagaucugaauccuggac

SEQ ID NO: 8148 - RNA, 22 nt, Homo sapiens
aaccagaucugaauccuggacu

SEQ ID NO: 8149 - RNA, 22 nt, Homo sapiens
accagaucugaauccuggacuc

SEQ ID NO: 8150 - RNA, 22 nt, Homo sapiens
ccagaucugaauccuggacucc

SEQ ID NO: 8151 - RNA, 22 nt, Homo sapiens
cagaucugaauccuggacuccg

SEQ ID NO: 8152 - RNA, 22 nt, Homo sapiens
agaucugaauccuggacuccgg

SEQ ID NO: 8153 - RNA, 22 nt, Homo sapiens
gaucugaauccuggacuccggg

SEQ ID NO: 8154 - RNA, 22 nt, Homo sapiens
aucugaauccuggacuccggga

SEQ ID NO: 8155 - RNA, 22 nt, Homo sapiens
ucugaauccuggacuccgggag

SEQ ID NO: 8156 - RNA, 22 nt, Homo sapiens
cugaauccuggacuccgggagg

SEQ ID NO: 8157 - RNA, 22 nt, Homo sapiens
ugaauccuggacuccgggaggc

SEQ ID NO: 8158 - RNA, 22 nt, Homo sapiens
gaauccuggacuccgggaggcc

SEQ ID NO: 8159 - RNA, 22 nt, Homo sapiens
aauccuggacuccgggaggccc

SEQ ID NO: 8160 - RNA, 22 nt, Homo sapiens
auccuggacuccgggaggcccg

SEQ ID NO: 8161 - RNA, 22 nt, Homo sapiens
uccuggacuccgggaggcccgu

SEQ ID NO: 8162 - RNA, 22 nt, Homo sapiens
ccuggacuccgggaggcccguc

SEQ ID NO: 8163 - RNA, 22 nt, Homo sapiens
cuggacuccgggaggcccgucu

SEQ ID NO: 8164 - RNA, 22 nt, Homo sapiens
uggacuccgggaggcccgucuc

SEQ ID NO: 8165 - RNA, 22 nt, Homo sapiens
ggacuccgggaggcccgucucu

SEQ ID NO: 8166 - RNA, 22 nt, Homo sapiens
gacuccgggaggcccgucucuc

SEQ ID NO: 8167 - RNA, 22 nt, Homo sapiens
acuccgggaggcccgucucucu

SEQ ID NO: 8168 - RNA, 22 nt, Homo sapiens
cuccgggaggcccgucucucug

SEQ ID NO: 8169 - RNA, 22 nt, Homo sapiens
uccgggaggcccgucucucugg

SEQ ID NO: 8170 - RNA, 22 nt, Homo sapiens
ccgggaggcccgucucucuggc

SEQ ID NO: 8171 - RNA, 22 nt, Homo sapiens
cgggaggcccgucucucuggcc

SEQ ID NO: 8172 - RNA, 22 nt, Homo sapiens
gggaggcccgucucucuggcca

SEQ ID NO: 8173 - RNA, 22 nt, Homo sapiens
ggaggcccgucucucuggccag

SEQ ID NO: 8174 - RNA, 22 nt, Homo sapiens
gaggcccgucucucuggccagc

SEQ ID NO: 8175 - RNA, 22 nt, Homo sapiens
aggcccgucucucuggccagcu

SEQ ID NO: 8176 - RNA, 22 nt, Homo sapiens
ggcccgucucucuggccagcuc

SEQ ID NO: 8177 - RNA, 22 nt, Homo sapiens
gcccgucucucuggccagcucc

SEQ ID NO: 8178 - RNA, 22 nt, Homo sapiens
cccgucucucuggccagcuccu

SEQ ID NO: 8179 - RNA, 22 nt, Homo sapiens
ccgucucucuggccagcuccuc

SEQ ID NO: 8180 - RNA, 22 nt, Homo sapiens
cgucucucuggccagcuccucc

SEQ ID NO: 8181 - RNA, 22 nt, Homo sapiens
gucucucuggccagcuccuccc

SEQ ID NO: 8182 - RNA, 22 nt, Homo sapiens
ucucucuggccagcuccucccg

SEQ ID NO: 8183 - RNA, 22 nt, Homo sapiens
cucucuggccagcuccucccgg

SEQ ID NO: 8184 - RNA, 22 nt, Homo sapiens
ucucuggccagcuccucccggg

SEQ ID NO: 8185 - RNA, 22 nt, Homo sapiens
cucuggccagcuccucccgggc

SEQ ID NO: 8186 - RNA, 22 nt, Homo sapiens
ucuggccagcuccucccgggcg

SEQ ID NO: 8187 - RNA, 22 nt, Homo sapiens
cuggccagcuccucccgggcgg

SEQ ID NO: 8188 - RNA, 22 nt, Homo sapiens
uggccagcuccucccgggcggc

SEQ ID NO: 8189 - RNA, 22 nt, Homo sapiens
ggccagcuccucccgggcggcg

SEQ ID NO: 8190 - RNA, 22 nt, Homo sapiens
gccagcuccucccgggcggcga

SEQ ID NO: 8191 - RNA, 22 nt, Homo sapiens
ccagcuccucccgggcggcgau

SEQ ID NO: 8192 - RNA, 22 nt, Homo sapiens
cagcuccucccgggcggcgaug

SEQ ID NO: 8193 - RNA, 22 nt, Homo sapiens
agcuccucccgggcggcgaugc

SEQ ID NO: 8194 - RNA, 22 nt, Homo sapiens
gcuccucccgggcggcgaugcc

SEQ ID NO: 8195 - RNA, 22 nt, Homo sapiens
cuccucccgggcggcgaugccu

SEQ ID NO: 8196 - RNA, 22 nt, Homo sapiens
uccucccgggcggcgaugccug

SEQ ID NO: 8197 - RNA, 22 nt, Homo sapiens
ccucccgggcggcgaugccugg

SEQ ID NO: 8198 - RNA, 22 nt, Homo sapiens
cucccgggcggcgaugccugga

SEQ ID NO: 8199 - RNA, 22 nt, Homo sapiens
ucccgggcggcgaugccuggaa

SEQ ID NO: 8200 - RNA, 22 nt, Homo sapiens
cccgggcggcgaugccuggaaa

SEQ ID NO: 8201 - RNA, 22 nt, Homo sapiens
ccgggcggcgaugccuggaaag

SEQ ID NO: 8202 - RNA, 22 nt, Homo sapiens
cgggcggcgaugccuggaaagc

SEQ ID NO: 8203 - RNA, 22 nt, Homo sapiens
gggcggcgaugccuggaaagcg

SEQ ID NO: 8204 - RNA, 22 nt, Homo sapiens
ggcggcgaugccuggaaagcga

SEQ ID NO: 8205 - RNA, 22 nt, Homo sapiens
gcggcgaugccuggaaagcgau

SEQ ID NO: 8206 - RNA, 22 nt, Homo sapiens
cggcgaugccuggaaagcgauc

SEQ ID NO: 8207 - RNA, 22 nt, Homo sapiens
ggcgaugccuggaaagcgaucc

SEQ ID NO: 8208 - RNA, 22 nt, Homo sapiens
gcgaugccuggaaagcgauccu

SEQ ID NO: 8209 - RNA, 22 nt, Homo sapiens
cgaugccuggaaagcgauccuu

SEQ ID NO: 8210 - RNA, 22 nt, Homo sapiens
gaugccuggaaagcgauccuuc

SEQ ID NO: 8211 - RNA, 22 nt, Homo sapiens
augccuggaaagcgauccuucu

SEQ ID NO: 8212 - RNA, 22 nt, Homo sapiens
ugccuggaaagcgauccuucuc

SEQ ID NO: 8213 - RNA, 22 nt, Homo sapiens
gccuggaaagcgauccuucuca

SEQ ID NO: 8214 - RNA, 22 nt, Homo sapiens
ccuggaaagcgauccuucucaa

SEQ ID NO: 8215 - RNA, 22 nt, Homo sapiens
cuggaaagcgauccuucucaaa

SEQ ID NO: 8216 - RNA, 22 nt, Homo sapiens
uggaaagcgauccuucucaaag

SEQ ID NO: 8217 - RNA, 22 nt, Homo sapiens
ggaaagcgauccuucucaaagg

SEQ ID NO: 8218 - RNA, 22 nt, Homo sapiens
gaaagcgauccuucucaaaggc

SEQ ID NO: 8219 - RNA, 22 nt, Homo sapiens
aaagcgauccuucucaaaggcu

SEQ ID NO: 8220 - RNA, 22 nt, Homo sapiens
aagcgauccuucucaaaggcuc

SEQ ID NO: 8221 - RNA, 22 nt, Homo sapiens
agcgauccuucucaaaggcucg

SEQ ID NO: 8222 - RNA, 22 nt, Homo sapiens
gcgauccuucucaaaggcucgg

SEQ ID NO: 8223 - RNA, 22 nt, Homo sapiens
cgauccuucucaaaggcucgga

SEQ ID NO: 8224 - RNA, 22 nt, Homo sapiens
gauccuucucaaaggcucggag

SEQ ID NO: 8225 - RNA, 22 nt, Homo sapiens
auccuucucaaaggcucggagg

SEQ ID NO: 8226 - RNA, 22 nt, Homo sapiens
uccuucucaaaggcucggagga

SEQ ID NO: 8227 - RNA, 22 nt, Homo sapiens
ccuucucaaaggcucggaggag

SEQ ID NO: 8228 - RNA, 22 nt, Homo sapiens
cuucucaaaggcucggaggagc

SEQ ID NO: 8229 - RNA, 22 nt, Homo sapiens
uucucaaaggcucggaggagca

SEQ ID NO: 8230 - RNA, 22 nt, Homo sapiens
ucucaaaggcucggaggagcag

SEQ ID NO: 8231 - RNA, 22 nt, Homo sapiens
cucaaaggcucggaggagcagg

SEQ ID NO: 8232 - RNA, 22 nt, Homo sapiens
ucaaaggcucggaggagcaggg

SEQ ID NO: 8233 - RNA, 22 nt, Homo sapiens
caaaggcucggaggagcagggc

SEQ ID NO: 8234 - RNA, 22 nt, Homo sapiens
aaaggcucggaggagcagggcg

SEQ ID NO: 8235 - RNA, 22 nt, Homo sapiens
aaggcucggaggagcagggcgg

SEQ ID NO: 8236 - RNA, 22 nt, Homo sapiens
aggcucggaggagcagggcggu

SEQ ID NO: 8237 - RNA, 22 nt, Homo sapiens
ggcucggaggagcagggcgguc

SEQ ID NO: 8238 - RNA, 22 nt, Homo sapiens
gcucggaggagcagggcggucu

SEQ ID NO: 8239 - RNA, 22 nt, Homo sapiens
cucggaggagcagggcggucug

SEQ ID NO: 8240 - RNA, 22 nt, Homo sapiens
ucggaggagcagggcggucugg

SEQ ID NO: 8241 - RNA, 22 nt, Homo sapiens
cggaggagcagggcggucuggg

SEQ ID NO: 8242 - RNA, 22 nt, Homo sapiens
ggaggagcagggcggucuggga

SEQ ID NO: 8243 - RNA, 22 nt, Homo sapiens
gaggagcagggcggucugggau

SEQ ID NO: 8244 - RNA, 22 nt, Homo sapiens
aggagcagggcggucugggauc

SEQ ID NO: 8245 - RNA, 22 nt, Homo sapiens
ggagcagggcggucugggaucc

SEQ ID NO: 8246 - RNA, 22 nt, Homo sapiens
gagcagggcggucugggauccg

SEQ ID NO: 8247 - RNA, 22 nt, Homo sapiens
agcagggcggucugggauccgg

SEQ ID NO: 8248 - RNA, 22 nt, Homo sapiens
gcagggcggucugggauccggu

SEQ ID NO: 8249 - RNA, 22 nt, Homo sapiens
cagggcggucugggauccggug

SEQ ID NO: 8250 - RNA, 22 nt, Homo sapiens
agggcggucugggauccgguga

SEQ ID NO: 8251 - RNA, 22 nt, Homo sapiens
gggcggucugggauccggugac

SEQ ID NO: 8252 - RNA, 22 nt, Homo sapiens
ggcggucugggauccggugacg

SEQ ID NO: 8253 - RNA, 22 nt, Homo sapiens
gcggucugggauccggugacgg

SEQ ID NO: 8254 - RNA, 22 nt, Homo sapiens
cggucugggauccggugacggc

SEQ ID NO: 8255 - RNA, 22 nt, Homo sapiens
ggucugggauccggugacggcg

SEQ ID NO: 8256 - RNA, 22 nt, Homo sapiens
gucugggauccggugacggcgg

SEQ ID NO: 8257 - RNA, 22 nt, Homo sapiens
ucugggauccggugacggcggu

SEQ ID NO: 8258 - RNA, 22 nt, Homo sapiens
cugggauccggugacggcgguc

SEQ ID NO: 8259 - RNA, 22 nt, Homo sapiens
ugggauccggugacggcggucc

SEQ ID NO: 8260 - RNA, 22 nt, Homo sapiens
gggauccggugacggcgguccg

SEQ ID NO: 8261 - RNA, 22 nt, Homo sapiens
ggauccggugacggcgguccgc

SEQ ID NO: 8262 - RNA, 22 nt, Homo sapiens
gauccggugacggcgguccgcu

SEQ ID NO: 8263 - RNA, 22 nt, Homo sapiens
auccggugacggcgguccgcuu

SEQ ID NO: 8264 - RNA, 22 nt, Homo sapiens
uccggugacggcgguccgcuuu

SEQ ID NO: 8265 - RNA, 22 nt, Homo sapiens
ccggugacggcgguccgcuuuc

SEQ ID NO: 8266 - RNA, 22 nt, Homo sapiens
cggugacggcgguccgcuuucg

SEQ ID NO: 8267 - RNA, 22 nt, Homo sapiens
ggugacggcgguccgcuuucgc

SEQ ID NO: 8268 - RNA, 22 nt, Homo sapiens
gugacggcgguccgcuuucgcc

SEQ ID NO: 8269 - RNA, 22 nt, Homo sapiens
ugacggcgguccgcuuucgccg

SEQ ID NO: 8270 - RNA, 22 nt, Homo sapiens
gacggcgguccgcuuucgccgg

SEQ ID NO: 8271 - RNA, 22 nt, Homo sapiens
acggcgguccgcuuucgccggc

SEQ ID NO: 8272 - RNA, 22 nt, Homo sapiens
cggcgguccgcuuucgccggcc

SEQ ID NO: 8273 - RNA, 22 nt, Homo sapiens
ggcgguccgcuuucgccggccu

SEQ ID NO: 8274 - RNA, 22 nt, Homo sapiens
gcgguccgcuuucgccggccuu

SEQ ID NO: 8275 - RNA, 22 nt, Homo sapiens
cgguccgcuuucgccggccuuc

SEQ ID NO: 8276 - RNA, 22 nt, Homo sapiens
gguccgcuuucgccggccuucu

SEQ ID NO: 8277 - RNA, 22 nt, Homo sapiens
guccgcuuucgccggccuucug

SEQ ID NO: 8278 - RNA, 22 nt, Homo sapiens
uccgcuuucgccggccuucugg

SEQ ID NO: 8279 - RNA, 22 nt, Homo sapiens
ccgcuuucgccggccuucuggc

SEQ ID NO: 8280 - RNA, 22 nt, Homo sapiens
cgcuuucgccggccuucuggcg

SEQ ID NO: 8281 - RNA, 22 nt, Homo sapiens
gcuuucgccggccuucuggcgg

SEQ ID NO: 8282 - RNA, 22 nt, Homo sapiens
cuuucgccggccuucuggcggg

SEQ ID NO: 8283 - RNA, 22 nt, Homo sapiens
uuucgccggccuucuggcgggc

SEQ ID NO: 8284 - RNA, 22 nt, Homo sapiens
uucgccggccuucuggcgggcc

SEQ ID NO: 8285 - RNA, 22 nt, Homo sapiens
ucgccggccuucuggcgggccg

SEQ ID NO: 8286 - RNA, 22 nt, Homo sapiens
cgccggccuucuggcgggccgc

SEQ ID NO: 8287 - RNA, 22 nt, Homo sapiens
gccggccuucuggcgggccgcg

SEQ ID NO: 8288 - RNA, 22 nt, Homo sapiens
ccggccuucuggcgggccgcgu

SEQ ID NO: 8289 - RNA, 22 nt, Homo sapiens
cggccuucuggcgggccgcguc

SEQ ID NO: 8290 - RNA, 22 nt, Homo sapiens
ggccuucuggcgggccgcgucu

SEQ ID NO: 8291 - RNA, 22 nt, Homo sapiens
gccuucuggcgggccgcgucuc

SEQ ID NO: 8292 - RNA, 22 nt, Homo sapiens
ccuucuggcgggccgcgucucc

SEQ ID NO: 8293 - RNA, 22 nt, Homo sapiens
cuucuggcgggccgcgucuccc

SEQ ID NO: 8294 - RNA, 22 nt, Homo sapiens
uucuggcgggccgcgucucccg

SEQ ID NO: 8295 - RNA, 22 nt, Homo sapiens
ucuggcgggccgcgucucccgg

SEQ ID NO: 8296 - RNA, 22 nt, Homo sapiens
cuggcgggccgcgucucccggg

SEQ ID NO: 8297 - RNA, 22 nt, Homo sapiens
uggcgggccgcgucucccgggc

SEQ ID NO: 8298 - RNA, 22 nt, Homo sapiens
ggcgggccgcgucucccgggcc

SEQ ID NO: 8299 - RNA, 22 nt, Homo sapiens
gcgggccgcgucucccgggcca

SEQ ID NO: 8300 - RNA, 22 nt, Homo sapiens
cgggccgcgucucccgggccag

SEQ ID NO: 8301 - RNA, 22 nt, Homo sapiens
gggccgcgucucccgggccagg

SEQ ID NO: 8302 - RNA, 22 nt, Homo sapiens
ggccgcgucucccgggccaggg

SEQ ID NO: 8303 - RNA, 22 nt, Homo sapiens
gccgcgucucccgggccagggc

SEQ ID NO: 8304 - RNA, 22 nt, Homo sapiens
ccgcgucucccgggccagggcc

SEQ ID NO: 8305 - RNA, 22 nt, Homo sapiens
cgcgucucccgggccagggccg

SEQ ID NO: 8306 - RNA, 22 nt, Homo sapiens
gcgucucccgggccagggccga

SEQ ID NO: 8307 - RNA, 22 nt, Homo sapiens
cgucucccgggccagggccgag

SEQ ID NO: 8308 - RNA, 22 nt, Homo sapiens
gucucccgggccagggccgaga

SEQ ID NO: 8309 - RNA, 22 nt, Homo sapiens
ucucccgggccagggccgagau

SEQ ID NO: 8310 - RNA, 22 nt, Homo sapiens
cucccgggccagggccgagauu

SEQ ID NO: 8311 - RNA, 22 nt, Homo sapiens
ucccgggccagggccgagauuc

SEQ ID NO: 8312 - RNA, 22 nt, Homo sapiens
cccgggccagggccgagauucc

SEQ ID NO: 8313 - RNA, 22 nt, Homo sapiens
ccgggccagggccgagauuccc

SEQ ID NO: 8314 - RNA, 22 nt, Homo sapiens
cgggccagggccgagauucccg

SEQ ID NO: 8315 - RNA, 22 nt, Homo sapiens
gggccagggccgagauucccgc

SEQ ID NO: 8316 - RNA, 22 nt, Homo sapiens
ggccagggccgagauucccgcc

SEQ ID NO: 8317 - RNA, 22 nt, Homo sapiens
gccagggccgagauucccgccg

SEQ ID NO: 8318 - RNA, 22 nt, Homo sapiens
ccagggccgagauucccgccgg

SEQ ID NO: 8319 - RNA, 22 nt, Homo sapiens
cagggccgagauucccgccggu

SEQ ID NO: 8320 - RNA, 22 nt, Homo sapiens
agggccgagauucccgccggug

SEQ ID NO: 8321 - RNA, 22 nt, Homo sapiens
gggccgagauucccgccggugc

SEQ ID NO: 8322 - RNA, 22 nt, Homo sapiens
ggccgagauucccgccggugcu

SEQ ID NO: 8323 - RNA, 22 nt, Homo sapiens
gccgagauucccgccggugcug

SEQ ID NO: 8324 - RNA, 22 nt, Homo sapiens
ccgagauucccgccggugcugc

SEQ ID NO: 8325 - RNA, 22 nt, Homo sapiens
cgagauucccgccggugcugcc

SEQ ID NO: 8326 - RNA, 22 nt, Homo sapiens
gagauucccgccggugcugccu

SEQ ID NO: 8327 - RNA, 22 nt, Homo sapiens
agauucccgccggugcugccuc

SEQ ID NO: 8328 - RNA, 22 nt, Homo sapiens
gauucccgccggugcugccuca

SEQ ID NO: 8329 - RNA, 22 nt, Homo sapiens
auucccgccggugcugccucag

SEQ ID NO: 8330 - RNA, 22 nt, Homo sapiens
uucccgccggugcugccucagc

SEQ ID NO: 8331 - RNA, 22 nt, Homo sapiens
ucccgccggugcugccucagcu

SEQ ID NO: 8332 - RNA, 22 nt, Homo sapiens
cccgccggugcugccucagcug

SEQ ID NO: 8333 - RNA, 22 nt, Homo sapiens
ccgccggugcugccucagcugg

SEQ ID NO: 8334 - RNA, 22 nt, Homo sapiens
cgccggugcugccucagcuggc

SEQ ID NO: 8335 - RNA, 22 nt, Homo sapiens
gccggugcugccucagcuggcg

SEQ ID NO: 8336 - RNA, 22 nt, Homo sapiens
ccggugcugccucagcuggcgu

SEQ ID NO: 8337 - RNA, 22 nt, Homo sapiens
cggugcugccucagcuggcgug

SEQ ID NO: 8338 - RNA, 22 nt, Homo sapiens
ggugcugccucagcuggcguga

SEQ ID NO: 8339 - RNA, 22 nt, Homo sapiens
gugcugccucagcuggcgugac

SEQ ID NO: 8340 - RNA, 22 nt, Homo sapiens
ugcugccucagcuggcgugacc

SEQ ID NO: 8341 - RNA, 22 nt, Homo sapiens
gcugccucagcuggcgugaccu

SEQ ID NO: 8342 - RNA, 22 nt, Homo sapiens
cugccucagcuggcgugaccuc

SEQ ID NO: 8343 - RNA, 22 nt, Homo sapiens
ugccucagcuggcgugaccucu

SEQ ID NO: 8344 - RNA, 22 nt, Homo sapiens
gccucagcuggcgugaccucuc

SEQ ID NO: 8345 - RNA, 22 nt, Homo sapiens
ccucagcuggcgugaccucuca

SEQ ID NO: 8346 - RNA, 22 nt, Homo sapiens
cucagcuggcgugaccucucau

SEQ ID NO: 8347 - RNA, 22 nt, Homo sapiens
ucagcuggcgugaccucucauu

SEQ ID NO: 8348 - RNA, 22 nt, Homo sapiens
cagcuggcgugaccucucauuc

SEQ ID NO: 8349 - RNA, 22 nt, Homo sapiens
agcuggcgugaccucucauucu

SEQ ID NO: 8350 - RNA, 22 nt, Homo sapiens
gcuggcgugaccucucauucug

SEQ ID NO: 8351 - RNA, 22 nt, Homo sapiens
cuggcgugaccucucauucuga

SEQ ID NO: 8352 - RNA, 22 nt, Homo sapiens
uggcgugaccucucauucugaa

SEQ ID NO: 8353 - RNA, 22 nt, Homo sapiens
ggcgugaccucucauucugaaa

SEQ ID NO: 8354 - RNA, 22 nt, Homo sapiens
gcgugaccucucauucugaaac

SEQ ID NO: 8355 - RNA, 22 nt, Homo sapiens
cgugaccucucauucugaaacc

SEQ ID NO: 8356 - RNA, 22 nt, Homo sapiens
gugaccucucauucugaaacca

SEQ ID NO: 8357 - RNA, 22 nt, Homo sapiens
ugaccucucauucugaaaccaa

SEQ ID NO: 8358 - RNA, 22 nt, Homo sapiens
gaccucucauucugaaaccaaa

SEQ ID NO: 8359 - RNA, 22 nt, Homo sapiens
accucucauucugaaaccaaau

SEQ ID NO: 8360 - RNA, 22 nt, Homo sapiens
ccucucauucugaaaccaaauc

SEQ ID NO: 8361 - RNA, 22 nt, Homo sapiens
cucucauucugaaaccaaaucu

SEQ ID NO: 8362 - RNA, 22 nt, Homo sapiens
ucucauucugaaaccaaaucug

SEQ ID NO: 8363 - RNA, 22 nt, Homo sapiens
cucauucugaaaccaaaucugg

SEQ ID NO: 8364 - RNA, 22 nt, Homo sapiens
ucauucugaaaccaaaucugga

SEQ ID NO: 8365 - RNA, 22 nt, Homo sapiens
cauucugaaaccaaaucuggac

SEQ ID NO: 8366 - RNA, 22 nt, Homo sapiens
auucugaaaccaaaucuggacc

SEQ ID NO: 8367 - RNA, 22 nt, Homo sapiens
uucugaaaccaaaucuggaccc

SEQ ID NO: 8368 - RNA, 22 nt, Homo sapiens
ucugaaaccaaaucuggacccu

SEQ ID NO: 8369 - RNA, 22 nt, Homo sapiens
cugaaaccaaaucuggacccug

SEQ ID NO: 8370 - RNA, 22 nt, Homo sapiens
ugaaaccaaaucuggacccugg

SEQ ID NO: 8371 - RNA, 22 nt, Homo sapiens
gaaaccaaaucuggacccuggg

SEQ ID NO: 8372 - RNA, 22 nt, Homo sapiens
aaaccaaaucuggacccugggc

SEQ ID NO: 8373 - RNA, 22 nt, Homo sapiens
aaccaaaucuggacccugggcu

SEQ ID NO: 8374 - RNA, 22 nt, Homo sapiens
accaaaucuggacccugggcuc

SEQ ID NO: 8375 - RNA, 22 nt, Homo sapiens
ccaaaucuggacccugggcucc

SEQ ID NO: 8376 - RNA, 22 nt, Homo sapiens
caaaucuggacccugggcuccg

SEQ ID NO: 8377 - RNA, 22 nt, Homo sapiens
aaaucuggacccugggcuccgg

SEQ ID NO: 8378 - RNA, 22 nt, Homo sapiens
aaucuggacccugggcuccgga

SEQ ID NO: 8379 - RNA, 22 nt, Homo sapiens
aucuggacccugggcuccggaa

SEQ ID NO: 8380 - RNA, 22 nt, Homo sapiens
ucuggacccugggcuccggaau

SEQ ID NO: 8381 - RNA, 22 nt, Homo sapiens
cuggacccugggcuccggaaug

SEQ ID NO: 8382 - RNA, 22 nt, Homo sapiens
uggacccugggcuccggaaugc

SEQ ID NO: 8383 - RNA, 22 nt, Homo sapiens
ggacccugggcuccggaaugcc

SEQ ID NO: 8384 - RNA, 22 nt, Homo sapiens
gacccugggcuccggaaugccg

SEQ ID NO: 8385 - RNA, 22 nt, Homo sapiens
acccugggcuccggaaugccga

SEQ ID NO: 8386 - RNA, 22 nt, Homo sapiens
cccugggcuccggaaugccgau

SEQ ID NO: 8387 - RNA, 22 nt, Homo sapiens
ccugggcuccggaaugccgaug

SEQ ID NO: 8388 - RNA, 22 nt, Homo sapiens
cugggcuccggaaugccgaugg

SEQ ID NO: 8389 - RNA, 22 nt, Homo sapiens
ugggcuccggaaugccgauggc

SEQ ID NO: 8390 - RNA, 22 nt, Homo sapiens
gggcuccggaaugccgauggcc

SEQ ID NO: 8391 - RNA, 22 nt, Homo sapiens
ggcuccggaaugccgauggccu

SEQ ID NO: 8392 - RNA, 22 nt, Homo sapiens
gcuccggaaugccgauggccug

SEQ ID NO: 8393 - RNA, 22 nt, Homo sapiens
cuccggaaugccgauggccugg

SEQ ID NO: 8394 - RNA, 22 nt, Homo sapiens
uccggaaugccgauggccuggg

SEQ ID NO: 8395 - RNA, 22 nt, Homo sapiens
ccggaaugccgauggccugggc

SEQ ID NO: 8396 - RNA, 22 nt, Homo sapiens
cggaaugccgauggccugggcc

SEQ ID NO: 8397 - RNA, 22 nt, Homo sapiens
ggaaugccgauggccugggcca

SEQ ID NO: 8398 - RNA, 22 nt, Homo sapiens
gaaugccgauggccugggccag

SEQ ID NO: 8399 - RNA, 22 nt, Homo sapiens
aaugccgauggccugggccagc

SEQ ID NO: 8400 - RNA, 22 nt, Homo sapiens
augccgauggccugggccagcc

SEQ ID NO: 8401 - RNA, 22 nt, Homo sapiens
ugccgauggccugggccagccg

SEQ ID NO: 8402 - RNA, 22 nt, Homo sapiens
gccgauggccugggccagccgu

SEQ ID NO: 8403 - RNA, 22 nt, Homo sapiens
ccgauggccugggccagccguu

SEQ ID NO: 8404 - RNA, 22 nt, Homo sapiens
cgauggccugggccagccguuc

SEQ ID NO: 8405 - RNA, 22 nt, Homo sapiens
gauggccugggccagccguucu

SEQ ID NO: 8406 - RNA, 22 nt, Homo sapiens
auggccugggccagccguucuc

SEQ ID NO: 8407 - RNA, 22 nt, Homo sapiens
uggccugggccagccguucucu

SEQ ID NO: 8408 - RNA, 22 nt, Homo sapiens
ggccugggccagccguucucug

SEQ ID NO: 8409 - RNA, 22 nt, Homo sapiens
gccugggccagccguucucugg

SEQ ID NO: 8410 - RNA, 22 nt, Homo sapiens
ccugggccagccguucucuggu

SEQ ID NO: 8411 - RNA, 22 nt, Homo sapiens
cugggccagccguucucuggug

SEQ ID NO: 8412 - RNA, 22 nt, Homo sapiens
ugggccagccguucucuggugg

SEQ ID NO: 8413 - RNA, 22 nt, Homo sapiens
gggccagccguucucugguggc

SEQ ID NO: 8414 - RNA, 22 nt, Homo sapiens
ggccagccguucucugguggcg

SEQ ID NO: 8415 - RNA, 22 nt, Homo sapiens
gccagccguucucugguggcga

SEQ ID NO: 8416 - RNA, 22 nt, Homo sapiens
ccagccguucucugguggcgau

SEQ ID NO: 8417 - RNA, 22 nt, Homo sapiens
cagccguucucugguggcgaug

SEQ ID NO: 8418 - RNA, 22 nt, Homo sapiens
agccguucucugguggcgaugc

SEQ ID NO: 8419 - RNA, 22 nt, Homo sapiens
gccguucucugguggcgaugcc

SEQ ID NO: 8420 - RNA, 22 nt, Homo sapiens
ccguucucugguggcgaugccc

SEQ ID NO: 8421 - RNA, 22 nt, Homo sapiens
cguucucugguggcgaugcccg

SEQ ID NO: 8422 - RNA, 22 nt, Homo sapiens
guucucugguggcgaugcccgg

SEQ ID NO: 8423 - RNA, 22 nt, Homo sapiens
uucucugguggcgaugcccggg

SEQ ID NO: 8424 - RNA, 22 nt, Homo sapiens
ucucugguggcgaugcccgggu

SEQ ID NO: 8425 - RNA, 22 nt, Homo sapiens
cucugguggcgaugcccgggua

SEQ ID NO: 8426 - RNA, 22 nt, Homo sapiens
ucugguggcgaugcccggguac

SEQ ID NO: 8427 - RNA, 22 nt, Homo sapiens
cugguggcgaugcccggguacg

SEQ ID NO: 8428 - RNA, 22 nt, Homo sapiens
ugguggcgaugcccggguacgg

SEQ ID NO: 8429 - RNA, 22 nt, Homo sapiens
gguggcgaugcccggguacggg

SEQ ID NO: 8430 - RNA, 22 nt, Homo sapiens
guggcgaugcccggguacgggu

SEQ ID NO: 8431 - RNA, 22 nt, Homo sapiens
uggcgaugcccggguacggguu

SEQ ID NO: 8432 - RNA, 22 nt, Homo sapiens
ggcgaugcccggguacggguuc

SEQ ID NO: 8433 - RNA, 22 nt, Homo sapiens
gcgaugcccggguacggguucc

SEQ ID NO: 8434 - RNA, 22 nt, Homo sapiens
cgaugcccggguacggguuccg

SEQ ID NO: 8435 - RNA, 22 nt, Homo sapiens
gaugcccggguacggguuccgc

SEQ ID NO: 8436 - RNA, 22 nt, Homo sapiens
augcccggguacggguuccgcu

SEQ ID NO: 8437 - RNA, 22 nt, Homo sapiens
ugcccggguacggguuccgcuc

SEQ ID NO: 8438 - RNA, 22 nt, Homo sapiens
gcccggguacggguuccgcuca

SEQ ID NO: 8439 - RNA, 22 nt, Homo sapiens
cccggguacggguuccgcucaa

SEQ ID NO: 8440 - RNA, 22 nt, Homo sapiens
ccggguacggguuccgcucaaa

SEQ ID NO: 8441 - RNA, 22 nt, Homo sapiens
cggguacggguuccgcucaaag

SEQ ID NO: 8442 - RNA, 22 nt, Homo sapiens
ggguacggguuccgcucaaagc

SEQ ID NO: 8443 - RNA, 22 nt, Homo sapiens
gguacggguuccgcucaaagca

SEQ ID NO: 8444 - RNA, 22 nt, Homo sapiens
guacggguuccgcucaaagcag

SEQ ID NO: 8445 - RNA, 22 nt, Homo sapiens
uacggguuccgcucaaagcagg

SEQ ID NO: 8446 - RNA, 22 nt, Homo sapiens
acggguuccgcucaaagcaggc

SEQ ID NO: 8447 - RNA, 22 nt, Homo sapiens
cggguuccgcucaaagcaggcu

SEQ ID NO: 8448 - RNA, 22 nt, Homo sapiens
ggguuccgcucaaagcaggcuc

SEQ ID NO: 8449 - RNA, 22 nt, Homo sapiens
gguuccgcucaaagcaggcucg

SEQ ID NO: 8450 - RNA, 22 nt, Homo sapiens
guuccgcucaaagcaggcucgc

SEQ ID NO: 8451 - RNA, 22 nt, Homo sapiens
uuccgcucaaagcaggcucgca

SEQ ID NO: 8452 - RNA, 22 nt, Homo sapiens
uccgcucaaagcaggcucgcag

SEQ ID NO: 8453 - RNA, 22 nt, Homo sapiens
ccgcucaaagcaggcucgcagg

SEQ ID NO: 8454 - RNA, 22 nt, Homo sapiens
cgcucaaagcaggcucgcaggg

SEQ ID NO: 8455 - RNA, 22 nt, Homo sapiens
gcucaaagcaggcucgcagggc

SEQ ID NO: 8456 - RNA, 22 nt, Homo sapiens
cucaaagcaggcucgcagggcc

SEQ ID NO: 8457 - RNA, 22 nt, Homo sapiens
ucaaagcaggcucgcagggccu

SEQ ID NO: 8458 - RNA, 22 nt, Homo sapiens
caaagcaggcucgcagggccuc

SEQ ID NO: 8459 - RNA, 22 nt, Homo sapiens
aaagcaggcucgcagggccucg

SEQ ID NO: 8460 - RNA, 22 nt, Homo sapiens
aagcaggcucgcagggccucgc

SEQ ID NO: 8461 - RNA, 22 nt, Homo sapiens
agcaggcucgcagggccucgcu

SEQ ID NO: 8462 - RNA, 22 nt, Homo sapiens
gcaggcucgcagggccucgcuu

SEQ ID NO: 8463 - RNA, 22 nt, Homo sapiens
caggcucgcagggccucgcuuu

SEQ ID NO: 8464 - RNA, 22 nt, Homo sapiens
aggcucgcagggccucgcuuug

SEQ ID NO: 8465 - RNA, 22 nt, Homo sapiens
ggcucgcagggccucgcuuugg

SEQ ID NO: 8466 - RNA, 22 nt, Homo sapiens
gcucgcagggccucgcuuuggc

SEQ ID NO: 8467 - RNA, 22 nt, Homo sapiens
cucgcagggccucgcuuuggcu

SEQ ID NO: 8468 - RNA, 22 nt, Homo sapiens
ucgcagggccucgcuuuggcuc

SEQ ID NO: 8469 - RNA, 22 nt, Homo sapiens
cgcagggccucgcuuuggcucg

SEQ ID NO: 8470 - RNA, 22 nt, Homo sapiens
gcagggccucgcuuuggcucgg

SEQ ID NO: 8471 - RNA, 22 nt, Homo sapiens
cagggccucgcuuuggcucggg

SEQ ID NO: 8472 - RNA, 22 nt, Homo sapiens
agggccucgcuuuggcucgggg

SEQ ID NO: 8473 - RNA, 22 nt, Homo sapiens
gggccucgcuuuggcucggggu

SEQ ID NO: 8474 - RNA, 22 nt, Homo sapiens
ggccucgcuuuggcucgggguc

SEQ ID NO: 8475 - RNA, 22 nt, Homo sapiens
gccucgcuuuggcucggggucc

SEQ ID NO: 8476 - RNA, 22 nt, Homo sapiens
ccucgcuuuggcucggggucca

SEQ ID NO: 8477 - RNA, 22 nt, Homo sapiens
cucgcuuuggcucgggguccaa

SEQ ID NO: 8478 - RNA, 22 nt, Homo sapiens
ucgcuuuggcucgggguccaaa

SEQ ID NO: 8479 - RNA, 22 nt, Homo sapiens
cgcuuuggcucgggguccaaac

SEQ ID NO: 8480 - RNA, 22 nt, Homo sapiens
gcuuuggcucgggguccaaacg

SEQ ID NO: 8481 - RNA, 22 nt, Homo sapiens
cuuuggcucgggguccaaacga

SEQ ID NO: 8482 - RNA, 22 nt, Homo sapiens
uuuggcucgggguccaaacgag

SEQ ID NO: 8483 - RNA, 22 nt, Homo sapiens
uuggcucgggguccaaacgagu

SEQ ID NO: 8484 - RNA, 22 nt, Homo sapiens
uggcucgggguccaaacgaguc

SEQ ID NO: 8485 - RNA, 22 nt, Homo sapiens
ggcucgggguccaaacgagucu

SEQ ID NO: 8486 - RNA, 22 nt, Homo sapiens
gcucgggguccaaacgagucuc

SEQ ID NO: 8487 - RNA, 22 nt, Homo sapiens
cucgggguccaaacgagucucc

SEQ ID NO: 8488 - RNA, 22 nt, Homo sapiens
ucgggguccaaacgagucuccg

SEQ ID NO: 8489 - RNA, 22 nt, Homo sapiens
cgggguccaaacgagucuccgu

SEQ ID NO: 8490 - RNA, 22 nt, Homo sapiens
gggguccaaacgagucuccguc

SEQ ID NO: 8491 - RNA, 22 nt, Homo sapiens
ggguccaaacgagucuccgucg

SEQ ID NO: 8492 - RNA, 22 nt, Homo sapiens
gguccaaacgagucuccgucgc

SEQ ID NO: 8493 - RNA, 22 nt, Homo sapiens
guccaaacgagucuccgucgcc

SEQ ID NO: 8494 - RNA, 22 nt, Homo sapiens
uccaaacgagucuccgucgccg

SEQ ID NO: 8495 - RNA, 22 nt, Homo sapiens
ccaaacgagucuccgucgccgu

SEQ ID NO: 8496 - RNA, 22 nt, Homo sapiens
caaacgagucuccgucgccguc

SEQ ID NO: 8497 - RNA, 22 nt, Homo sapiens
aaacgagucuccgucgccgucc

SEQ ID NO: 8498 - RNA, 22 nt, Homo sapiens
aacgagucuccgucgccguccu

SEQ ID NO: 8499 - RNA, 22 nt, Homo sapiens
acgagucuccgucgccguccuc

SEQ ID NO: 8500 - RNA, 22 nt, Homo sapiens
cgagucuccgucgccguccucg

SEQ ID NO: 8501 - RNA, 22 nt, Homo sapiens
gagucuccgucgccguccucgu

SEQ ID NO: 8502 - RNA, 22 nt, Homo sapiens
agucuccgucgccguccucguc

SEQ ID NO: 8503 - RNA, 22 nt, Homo sapiens
gucuccgucgccguccucgucc

SEQ ID NO: 8504 - RNA, 22 nt, Homo sapiens
ucuccgucgccguccucguccc

SEQ ID NO: 8505 - RNA, 22 nt, Homo sapiens
cuccgucgccguccucgucccc

SEQ ID NO: 8506 - RNA, 22 nt, Homo sapiens
uccgucgccguccucguccccg

SEQ ID NO: 8507 - RNA, 22 nt, Homo sapiens
ccgucgccguccucguccccgg

SEQ ID NO: 8508 - RNA, 22 nt, Homo sapiens
cgucgccguccucguccccggg

SEQ ID NO: 8509 - RNA, 22 nt, Homo sapiens
gucgccguccucguccccgggc

SEQ ID NO: 8510 - RNA, 22 nt, Homo sapiens
ucgccguccucguccccgggcu

SEQ ID NO: 8511 - RNA, 22 nt, Homo sapiens
cgccguccucguccccgggcuu

SEQ ID NO: 8512 - RNA, 22 nt, Homo sapiens
gccguccucguccccgggcuuc

SEQ ID NO: 8513 - RNA, 22 nt, Homo sapiens
ccguccucguccccgggcuucc

SEQ ID NO: 8514 - RNA, 22 nt, Homo sapiens
cguccucguccccgggcuuccg

SEQ ID NO: 8515 - RNA, 22 nt, Homo sapiens
guccucguccccgggcuuccgc

SEQ ID NO: 8516 - RNA, 22 nt, Homo sapiens
uccucguccccgggcuuccgcg

SEQ ID NO: 8517 - RNA, 22 nt, Homo sapiens
ccucguccccgggcuuccgcgg

SEQ ID NO: 8518 - RNA, 22 nt, Homo sapiens
cucguccccgggcuuccgcggg

SEQ ID NO: 8519 - RNA, 22 nt, Homo sapiens
ucguccccgggcuuccgcgggg

SEQ ID NO: 8520 - RNA, 22 nt, Homo sapiens
cguccccgggcuuccgcgggga

SEQ ID NO: 8521 - RNA, 22 nt, Homo sapiens
guccccgggcuuccgcggggag

SEQ ID NO: 8522 - RNA, 22 nt, Homo sapiens
uccccgggcuuccgcggggagg

SEQ ID NO: 8523 - RNA, 22 nt, Homo sapiens
ccccgggcuuccgcggggaggg

SEQ ID NO: 8524 - RNA, 22 nt, Homo sapiens
cccgggcuuccgcggggagggu

SEQ ID NO: 8525 - RNA, 22 nt, Homo sapiens
ccgggcuuccgcggggagggug

SEQ ID NO: 8526 - RNA, 22 nt, Homo sapiens
cgggcuuccgcggggagggugc

SEQ ID NO: 8527 - RNA, 22 nt, Homo sapiens
gggcuuccgcggggagggugcu

SEQ ID NO: 8528 - RNA, 22 nt, Homo sapiens
ggcuuccgcggggagggugcug

SEQ ID NO: 8529 - RNA, 22 nt, Homo sapiens
gcuuccgcggggagggugcugu

SEQ ID NO: 8530 - RNA, 22 nt, Homo sapiens
cuuccgcggggagggugcuguc

SEQ ID NO: 8531 - RNA, 22 nt, Homo sapiens
uuccgcggggagggugcugucc

SEQ ID NO: 8532 - RNA, 22 nt, Homo sapiens
uccgcggggagggugcuguccg

SEQ ID NO: 8533 - RNA, 22 nt, Homo sapiens
ccgcggggagggugcuguccga

SEQ ID NO: 8534 - RNA, 22 nt, Homo sapiens
cgcggggagggugcuguccgag

SEQ ID NO: 8535 - RNA, 22 nt, Homo sapiens
gcggggagggugcuguccgagg

SEQ ID NO: 8536 - RNA, 22 nt, Homo sapiens
cggggagggugcuguccgaggg

SEQ ID NO: 8537 - RNA, 22 nt, Homo sapiens
ggggagggugcuguccgagggu

SEQ ID NO: 8538 - RNA, 22 nt, Homo sapiens
gggagggugcuguccgagggug

SEQ ID NO: 8539 - RNA, 22 nt, Homo sapiens
ggagggugcuguccgagggugu

SEQ ID NO: 8540 - RNA, 22 nt, Homo sapiens
gagggugcuguccgaggguguc

SEQ ID NO: 8541 - RNA, 22 nt, Homo sapiens
agggugcuguccgagggugucg

SEQ ID NO: 8542 - RNA, 22 nt, Homo sapiens
gggugcuguccgagggugucgg

SEQ ID NO: 8543 - RNA, 22 nt, Homo sapiens
ggugcuguccgagggugucggg

SEQ ID NO: 8544 - RNA, 22 nt, Homo sapiens
gugcuguccgagggugucggga

SEQ ID NO: 8545 - RNA, 22 nt, Homo sapiens
ugcuguccgagggugucgggag

SEQ ID NO: 8546 - RNA, 22 nt, Homo sapiens
gcuguccgagggugucgggagg

SEQ ID NO: 8547 - RNA, 22 nt, Homo sapiens
cuguccgagggugucgggaggg

SEQ ID NO: 8548 - RNA, 22 nt, Homo sapiens
uguccgagggugucgggagggc

SEQ ID NO: 8549 - RNA, 22 nt, Homo sapiens
guccgagggugucgggagggcc

SEQ ID NO: 8550 - RNA, 22 nt, Homo sapiens
uccgagggugucgggagggcca

SEQ ID NO: 8551 - RNA, 22 nt, Homo sapiens
ccgagggugucgggagggccau

SEQ ID NO: 8552 - RNA, 22 nt, Homo sapiens
cgagggugucgggagggccauc

SEQ ID NO: 8553 - RNA, 22 nt, Homo sapiens
gagggugucgggagggccaucg

SEQ ID NO: 8554 - RNA, 22 nt, Homo sapiens
agggugucgggagggccaucgc

SEQ ID NO: 8555 - RNA, 22 nt, Homo sapiens
gggugucgggagggccaucgcg

SEQ ID NO: 8556 - RNA, 22 nt, Homo sapiens
ggugucgggagggccaucgcgg

SEQ ID NO: 8557 - RNA, 22 nt, Homo sapiens
gugucgggagggccaucgcggu

SEQ ID NO: 8558 - RNA, 22 nt, Homo sapiens
ugucgggagggccaucgcggug

SEQ ID NO: 8559 - RNA, 22 nt, Homo sapiens
gucgggagggccaucgcgguga

SEQ ID NO: 8560 - RNA, 22 nt, Homo sapiens
ucgggagggccaucgcggugag

SEQ ID NO: 8561 - RNA, 22 nt, Homo sapiens
cgggagggccaucgcggugagc

SEQ ID NO: 8562 - RNA, 22 nt, Homo sapiens
gggagggccaucgcggugagcc

SEQ ID NO: 8563 - RNA, 22 nt, Homo sapiens
ggagggccaucgcggugagccc

SEQ ID NO: 8564 - RNA, 22 nt, Homo sapiens
gagggccaucgcggugagcccc

SEQ ID NO: 8565 - RNA, 22 nt, Homo sapiens
agggccaucgcggugagccccg

SEQ ID NO: 8566 - RNA, 22 nt, Homo sapiens
gggccaucgcggugagccccgg

SEQ ID NO: 8567 - RNA, 22 nt, Homo sapiens
ggccaucgcggugagccccggc

SEQ ID NO: 8568 - RNA, 22 nt, Homo sapiens
gccaucgcggugagccccggcc

SEQ ID NO: 8569 - RNA, 22 nt, Homo sapiens
ccaucgcggugagccccggccg

SEQ ID NO: 8570 - RNA, 22 nt, Homo sapiens
caucgcggugagccccggccgg

SEQ ID NO: 8571 - RNA, 22 nt, Homo sapiens
aucgcggugagccccggccgga

SEQ ID NO: 8572 - RNA, 22 nt, Homo sapiens
ucgcggugagccccggccggaa

SEQ ID NO: 8573 - RNA, 22 nt, Homo sapiens
cgcggugagccccggccggaau

SEQ ID NO: 8574 - RNA, 22 nt, Homo sapiens
gcggugagccccggccggaauu

SEQ ID NO: 8575 - RNA, 22 nt, Homo sapiens
cggugagccccggccggaauuu

SEQ ID NO: 8576 - RNA, 22 nt, Homo sapiens
ggugagccccggccggaauuuc

SEQ ID NO: 8577 - RNA, 22 nt, Homo sapiens
gugagccccggccggaauuuca

SEQ ID NO: 8578 - RNA, 22 nt, Homo sapiens
ugagccccggccggaauuucac

SEQ ID NO: 8579 - RNA, 22 nt, Homo sapiens
gagccccggccggaauuucacg

SEQ ID NO: 8580 - RNA, 22 nt, Homo sapiens
agccccggccggaauuucacgg

SEQ ID NO: 8581 - RNA, 22 nt, Homo sapiens
gccccggccggaauuucacgga

SEQ ID NO: 8582 - RNA, 22 nt, Homo sapiens
ccccggccggaauuucacggac

SEQ ID NO: 8583 - RNA, 22 nt, Homo sapiens
cccggccggaauuucacggacg

SEQ ID NO: 8584 - RNA, 22 nt, Homo sapiens
ccggccggaauuucacggacgg

SEQ ID NO: 8585 - RNA, 22 nt, Homo sapiens
cggccggaauuucacggacgga

SEQ ID NO: 8586 - RNA, 22 nt, Homo sapiens
ggccggaauuucacggacggac

SEQ ID NO: 8587 - RNA, 22 nt, Homo sapiens
gccggaauuucacggacggacg

SEQ ID NO: 8588 - RNA, 22 nt, Homo sapiens
ccggaauuucacggacggacgc

SEQ ID NO: 8589 - RNA, 22 nt, Homo sapiens
cggaauuucacggacggacgcg

SEQ ID NO: 8590 - RNA, 22 nt, Homo sapiens
ggaauuucacggacggacgcgg

SEQ ID NO: 8591 - RNA, 22 nt, Homo sapiens
gaauuucacggacggacgcggg

SEQ ID NO: 8592 - RNA, 22 nt, Homo sapiens
aauuucacggacggacgcgggc

SEQ ID NO: 8593 - RNA, 22 nt, Homo sapiens
auuucacggacggacgcgggca

SEQ ID NO: 8594 - RNA, 22 nt, Homo sapiens
uuucacggacggacgcgggcag

SEQ ID NO: 8595 - RNA, 22 nt, Homo sapiens
uucacggacggacgcgggcaga

SEQ ID NO: 8596 - RNA, 22 nt, Homo sapiens
ucacggacggacgcgggcagag

SEQ ID NO: 8597 - RNA, 22 nt, Homo sapiens
cacggacggacgcgggcagaga

SEQ ID NO: 8598 - RNA, 22 nt, Homo sapiens
acggacggacgcgggcagagag

SEQ ID NO: 8599 - RNA, 22 nt, Homo sapiens
cggacggacgcgggcagagaga

SEQ ID NO: 8600 - RNA, 22 nt, Homo sapiens
ggacggacgcgggcagagagag

SEQ ID NO: 8601 - RNA, 22 nt, Homo sapiens
gacggacgcgggcagagagagg

SEQ ID NO: 8602 - RNA, 22 nt, Homo sapiens
acggacgcgggcagagagaggc

SEQ ID NO: 8603 - RNA, 22 nt, Homo sapiens
cggacgcgggcagagagaggcc

SEQ ID NO: 8604 - RNA, 22 nt, Homo sapiens
ggacgcgggcagagagaggccg

SEQ ID NO: 8605 - RNA, 22 nt, Homo sapiens
gacgcgggcagagagaggccgg

SEQ ID NO: 8606 - RNA, 22 nt, Homo sapiens
acgcgggcagagagaggccggc

SEQ ID NO: 8607 - RNA, 22 nt, Homo sapiens
cgcgggcagagagaggccggcg

SEQ ID NO: 8608 - RNA, 22 nt, Homo sapiens
gcgggcagagagaggccggcgg

SEQ ID NO: 8609 - RNA, 22 nt, Homo sapiens
cgggcagagagaggccggcggg

SEQ ID NO: 8610 - RNA, 22 nt, Homo sapiens
gggcagagagaggccggcgggc

SEQ ID NO: 8611 - RNA, 22 nt, Homo sapiens
ggcagagagaggccggcgggcu

SEQ ID NO: 8612 - RNA, 22 nt, Homo sapiens
gcagagagaggccggcgggcuc

SEQ ID NO: 8613 - RNA, 22 nt, Homo sapiens
cagagagaggccggcgggcucc

SEQ ID NO: 8614 - RNA, 22 nt, Homo sapiens
agagagaggccggcgggcuccc

SEQ ID NO: 8615 - RNA, 22 nt, Homo sapiens
gagagaggccggcgggcucccg

SEQ ID NO: 8616 - RNA, 22 nt, Homo sapiens
agagaggccggcgggcucccgu

SEQ ID NO: 8617 - RNA, 22 nt, Homo sapiens
gagaggccggcgggcucccgug

SEQ ID NO: 8618 - RNA, 22 nt, Homo sapiens
agaggccggcgggcucccgugc

SEQ ID NO: 8619 - RNA, 22 nt, Homo sapiens
gaggccggcgggcucccgugca

SEQ ID NO: 8620 - RNA, 22 nt, Homo sapiens
aggccggcgggcucccgugcac

SEQ ID NO: 8621 - RNA, 22 nt, Homo sapiens
ggccggcgggcucccgugcacc

SEQ ID NO: 8622 - RNA, 22 nt, Homo sapiens
gccggcgggcucccgugcaccu

SEQ ID NO: 8623 - RNA, 22 nt, Homo sapiens
ccggcgggcucccgugcaccuc

SEQ ID NO: 8624 - RNA, 22 nt, Homo sapiens
cggcgggcucccgugcaccuca

SEQ ID NO: 8625 - RNA, 22 nt, Homo sapiens
ggcgggcucccgugcaccucag

SEQ ID NO: 8626 - RNA, 22 nt, Homo sapiens
gcgggcucccgugcaccucagc

SEQ ID NO: 8627 - RNA, 22 nt, Homo sapiens
cgggcucccgugcaccucagcc

SEQ ID NO: 8628 - RNA, 22 nt, Homo sapiens
gggcucccgugcaccucagccg

SEQ ID NO: 8629 - RNA, 22 nt, Homo sapiens
ggcucccgugcaccucagccgg

SEQ ID NO: 8630 - RNA, 22 nt, Homo sapiens
gcucccgugcaccucagccgga

SEQ ID NO: 8631 - RNA, 22 nt, Homo sapiens
cucccgugcaccucagccggac

SEQ ID NO: 8632 - RNA, 22 nt, Homo sapiens
ucccgugcaccucagccggacu

SEQ ID NO: 8633 - RNA, 22 nt, Homo sapiens
cccgugcaccucagccggacug

SEQ ID NO: 8634 - RNA, 22 nt, Homo sapiens
ccgugcaccucagccggacugu

SEQ ID NO: 8635 - RNA, 22 nt, Homo sapiens
cgugcaccucagccggacugug

SEQ ID NO: 8636 - RNA, 22 nt, Homo sapiens
gugcaccucagccggacugugc

SEQ ID NO: 8637 - RNA, 22 nt, Homo sapiens
ugcaccucagccggacugugca

SEQ ID NO: 8638 - RNA, 22 nt, Homo sapiens
gcaccucagccggacugugcac

SEQ ID NO: 8639 - RNA, 22 nt, Homo sapiens
caccucagccggacugugcacu

SEQ ID NO: 8640 - RNA, 22 nt, Homo sapiens
accucagccggacugugcacug

SEQ ID NO: 8641 - RNA, 22 nt, Homo sapiens
ccucagccggacugugcacugc

SEQ ID NO: 8642 - RNA, 22 nt, Homo sapiens
cucagccggacugugcacugcg

SEQ ID NO: 8643 - RNA, 22 nt, Homo sapiens
ucagccggacugugcacugcgg

SEQ ID NO: 8644 - RNA, 22 nt, Homo sapiens
cagccggacugugcacugcggc

SEQ ID NO: 8645 - RNA, 22 nt, Homo sapiens
agccggacugugcacugcggca

SEQ ID NO: 8646 - RNA, 22 nt, Homo sapiens
gccggacugugcacugcggcag

SEQ ID NO: 8647 - RNA, 22 nt, Homo sapiens
ccggacugugcacugcggcagg

SEQ ID NO: 8648 - RNA, 22 nt, Homo sapiens
cggacugugcacugcggcaggu

SEQ ID NO: 8649 - RNA, 22 nt, Homo sapiens
ggacugugcacugcggcaggug

SEQ ID NO: 8650 - RNA, 22 nt, Homo sapiens
gacugugcacugcggcaggugc

SEQ ID NO: 8651 - RNA, 22 nt, Homo sapiens
acugugcacugcggcaggugca

SEQ ID NO: 8652 - RNA, 22 nt, Homo sapiens
cugugcacugcggcaggugcag

SEQ ID NO: 8653 - RNA, 22 nt, Homo sapiens
ugugcacugcggcaggugcagc

SEQ ID NO: 8654 - RNA, 22 nt, Homo sapiens
gugcacugcggcaggugcagcc

SEQ ID NO: 8655 - RNA, 22 nt, Homo sapiens
ugcacugcggcaggugcagcca

SEQ ID NO: 8656 - RNA, 22 nt, Homo sapiens
gcacugcggcaggugcagccag

SEQ ID NO: 8657 - RNA, 22 nt, Homo sapiens
cacugcggcaggugcagccagg

SEQ ID NO: 8658 - RNA, 22 nt, Homo sapiens
acugcggcaggugcagccagga

SEQ ID NO: 8659 - RNA, 22 nt, Homo sapiens
cugcggcaggugcagccaggag

SEQ ID NO: 8660 - RNA, 22 nt, Homo sapiens
ugcggcaggugcagccaggagg

SEQ ID NO: 8661 - RNA, 22 nt, Homo sapiens
gcggcaggugcagccaggaggc

SEQ ID NO: 8662 - RNA, 22 nt, Homo sapiens
cggcaggugcagccaggaggcc

SEQ ID NO: 8663 - RNA, 22 nt, Homo sapiens
ggcaggugcagccaggaggccu

SEQ ID NO: 8664 - RNA, 22 nt, Homo sapiens
gcaggugcagccaggaggccug

SEQ ID NO: 8665 - RNA, 22 nt, Homo sapiens
caggugcagccaggaggccugc

SEQ ID NO: 8666 - RNA, 22 nt, Homo sapiens
aggugcagccaggaggccugcc

SEQ ID NO: 8667 - RNA, 22 nt, Homo sapiens
ggugcagccaggaggccugccc

SEQ ID NO: 8668 - RNA, 22 nt, Homo sapiens
gugcagccaggaggccugcccg

SEQ ID NO: 8669 - RNA, 22 nt, Homo sapiens
ugcagccaggaggccugcccgg

SEQ ID NO: 8670 - RNA, 22 nt, Homo sapiens
gcagccaggaggccugcccgga

SEQ ID NO: 8671 - RNA, 22 nt, Homo sapiens
cagccaggaggccugcccggac

SEQ ID NO: 8672 - RNA, 22 nt, Homo sapiens
agccaggaggccugcccggaca

SEQ ID NO: 8673 - RNA, 22 nt, Homo sapiens
gccaggaggccugcccggacag

SEQ ID NO: 8674 - RNA, 22 nt, Homo sapiens
ccaggaggccugcccggacagc

SEQ ID NO: 8675 - RNA, 22 nt, Homo sapiens
caggaggccugcccggacagcc

SEQ ID NO: 8676 - RNA, 22 nt, Homo sapiens
aggaggccugcccggacagcca

SEQ ID NO: 8677 - RNA, 22 nt, Homo sapiens
ggaggccugcccggacagccag

SEQ ID NO: 8678 - RNA, 22 nt, Homo sapiens
gaggccugcccggacagccagc

SEQ ID NO: 8679 - RNA, 22 nt, Homo sapiens
aggccugcccggacagccagcc

SEQ ID NO: 8680 - RNA, 22 nt, Homo sapiens
ggccugcccggacagccagcca

SEQ ID NO: 8681 - RNA, 22 nt, Homo sapiens
gccugcccggacagccagccag

SEQ ID NO: 8682 - RNA, 22 nt, Homo sapiens
ccugcccggacagccagccagc

SEQ ID NO: 8683 - RNA, 22 nt, Homo sapiens
cugcccggacagccagccagcc

SEQ ID NO: 8684 - RNA, 22 nt, Homo sapiens
ugcccggacagccagccagcca

SEQ ID NO: 8685 - RNA, 22 nt, Homo sapiens
gcccggacagccagccagccag

SEQ ID NO: 8686 - RNA, 22 nt, Homo sapiens
cccggacagccagccagccagc

SEQ ID NO: 8687 - RNA, 22 nt, Homo sapiens
ccggacagccagccagccagcc

SEQ ID NO: 8688 - RNA, 22 nt, Homo sapiens
cggacagccagccagccagcca

SEQ ID NO: 8689 - RNA, 22 nt, Homo sapiens
ggacagccagccagccagccag

SEQ ID NO: 8690 - RNA, 22 nt, Homo sapiens
gacagccagccagccagccagc

SEQ ID NO: 8691 - RNA, 22 nt, Homo sapiens
acagccagccagccagccagcc

SEQ ID NO: 8692 - RNA, 22 nt, Homo sapiens
cagccagccagccagccagccg

SEQ ID NO: 8693 - RNA, 22 nt, Homo sapiens
agccagccagccagccagccgc

SEQ ID NO: 8694 - RNA, 22 nt, Homo sapiens
gccagccagccagccagccgcc

SEQ ID NO: 8695 - RNA, 22 nt, Homo sapiens
ccagccagccagccagccgccc

SEQ ID NO: 8696 - RNA, 22 nt, Homo sapiens
cagccagccagccagccgcccu

SEQ ID NO: 8697 - RNA, 22 nt, Homo sapiens
agccagccagccagccgcccuu

SEQ ID NO: 8698 - RNA, 22 nt, Homo sapiens
gccagccagccagccgcccuug

SEQ ID NO: 8699 - RNA, 22 nt, Homo sapiens
ccagccagccagccgcccuugu

SEQ ID NO: 8700 - RNA, 22 nt, Homo sapiens
cagccagccagccgcccuugua

SEQ ID NO: 8701 - RNA, 22 nt, Homo sapiens
agccagccagccgcccuuguaa

SEQ ID NO: 8702 - RNA, 22 nt, Homo sapiens
gccagccagccgcccuuguaaa

SEQ ID NO: 8703 - RNA, 22 nt, Homo sapiens
ccagccagccgcccuuguaaag

SEQ ID NO: 8704 - RNA, 22 nt, Homo sapiens
cagccagccgcccuuguaaagg

SEQ ID NO: 8705 - RNA, 22 nt, Homo sapiens
agccagccgcccuuguaaaggc

SEQ ID NO: 8706 - RNA, 22 nt, Homo sapiens
gccagccgcccuuguaaaggcc

SEQ ID NO: 8707 - RNA, 22 nt, Homo sapiens
ccagccgcccuuguaaaggccc

SEQ ID NO: 8708 - RNA, 22 nt, Homo sapiens
cagccgcccuuguaaaggccca

SEQ ID NO: 8709 - RNA, 22 nt, Homo sapiens
agccgcccuuguaaaggcccac

SEQ ID NO: 8710 - RNA, 22 nt, Homo sapiens
gccgcccuuguaaaggcccaca

SEQ ID NO: 8711 - RNA, 22 nt, Homo sapiens
ccgcccuuguaaaggcccacag

SEQ ID NO: 8712 - RNA, 22 nt, Homo sapiens
cgcccuuguaaaggcccacagg

SEQ ID NO: 8713 - RNA, 22 nt, Homo sapiens
gcccuuguaaaggcccacaggc

SEQ ID NO: 8714 - RNA, 22 nt, Homo sapiens
cccuuguaaaggcccacaggca

SEQ ID NO: 8715 - RNA, 22 nt, Homo sapiens
ccuuguaaaggcccacaggcag

SEQ ID NO: 8716 - RNA, 22 nt, Homo sapiens
cuuguaaaggcccacaggcagg

SEQ ID NO: 8717 - RNA, 22 nt, Homo sapiens
uuguaaaggcccacaggcaggc

SEQ ID NO: 8718 - RNA, 22 nt, Homo sapiens
uguaaaggcccacaggcaggca

SEQ ID NO: 8719 - RNA, 22 nt, Homo sapiens
guaaaggcccacaggcaggcag

SEQ ID NO: 8720 - RNA, 22 nt, Homo sapiens
uaaaggcccacaggcaggcagg

SEQ ID NO: 8721 - RNA, 22 nt, Homo sapiens
aaaggcccacaggcaggcaggc

SEQ ID NO: 8722 - RNA, 22 nt, Homo sapiens
aaggcccacaggcaggcaggcu

SEQ ID NO: 8723 - RNA, 22 nt, Homo sapiens
aggcccacaggcaggcaggcuc

SEQ ID NO: 8724 - RNA, 22 nt, Homo sapiens
ggcccacaggcaggcaggcucc

SEQ ID NO: 8725 - RNA, 22 nt, Homo sapiens
gcccacaggcaggcaggcucca

SEQ ID NO: 8726 - RNA, 22 nt, Homo sapiens
cccacaggcaggcaggcuccac

SEQ ID NO: 8727 - RNA, 22 nt, Homo sapiens
ccacaggcaggcaggcuccacc

SEQ ID NO: 8728 - RNA, 22 nt, Homo sapiens
cacaggcaggcaggcuccaccc

SEQ ID NO: 8729 - RNA, 22 nt, Homo sapiens
acaggcaggcaggcuccacccc

SEQ ID NO: 8730 - RNA, 22 nt, Homo sapiens
caggcaggcaggcuccaccccu

SEQ ID NO: 8731 - RNA, 22 nt, Homo sapiens
aggcaggcaggcuccaccccuu

SEQ ID NO: 8732 - RNA, 22 nt, Homo sapiens
ggcaggcaggcuccaccccuuc

SEQ ID NO: 8733 - RNA, 22 nt, Homo sapiens
gcaggcaggcuccaccccuuca

SEQ ID NO: 8734 - RNA, 45 nt, Homo sapiens
caggcaggcuccaccccuucaugagauguaacucuaauccagguu

SEQ ID NO: 8735 - RNA, 23 nt, Homo sapiens
agauguaacucuaauccagguuu

SEQ ID NO: 8736 - RNA, 23 nt, Homo sapiens
gauguaacucuaauccagguuug

SEQ ID NO: 8737 - RNA, 23 nt, Homo sapiens
auguaacucuaauccagguuugc

SEQ ID NO: 8738 - RNA, 23 nt, Homo sapiens
uguaacucuaauccagguuugcc

SEQ ID NO: 8739 - RNA, 23 nt, Homo sapiens
guaacucuaauccagguuugccu

SEQ ID NO: 8740 - RNA, 23 nt, Homo sapiens
uaacucuaauccagguuugccua

SEQ ID NO: 8741 - RNA, 23 nt, Homo sapiens
aacucuaauccagguuugccuag

SEQ ID NO: 8742 - RNA, 23 nt, Homo sapiens
acucuaauccagguuugccuaga

SEQ ID NO: 8743 - RNA, 23 nt, Homo sapiens
cucuaauccagguuugccuagac

SEQ ID NO: 8744 - RNA, 23 nt, Homo sapiens
ucuaauccagguuugccuagaca

SEQ ID NO: 8745 - RNA, 23 nt, Homo sapiens
cuaauccagguuugccuagacag

SEQ ID NO: 8746 - RNA, 23 nt, Homo sapiens
uaauccagguuugccuagacagc

SEQ ID NO: 8747 - RNA, 23 nt, Homo sapiens
aauccagguuugccuagacagcg

SEQ ID NO: 8748 - RNA, 23 nt, Homo sapiens
auccagguuugccuagacagcgu

SEQ ID NO: 8749 - RNA, 23 nt, Homo sapiens
uccagguuugccuagacagcguc

SEQ ID NO: 8750 - RNA, 23 nt, Homo sapiens
ccagguuugccuagacagcgucg

SEQ ID NO: 8751 - RNA, 23 nt, Homo sapiens
cagguuugccuagacagcgucgg

SEQ ID NO: 8752 - RNA, 23 nt, Homo sapiens
agguuugccuagacagcgucgga

SEQ ID NO: 8753 - RNA, 23 nt, Homo sapiens
gguuugccuagacagcgucggaa

SEQ ID NO: 8754 - RNA, 23 nt, Homo sapiens
guuugccuagacagcgucggaag

SEQ ID NO: 8755 - RNA, 23 nt, Homo sapiens
uuugccuagacagcgucggaagg

SEQ ID NO: 8756 - RNA, 23 nt, Homo sapiens
uugccuagacagcgucggaaggu

SEQ ID NO: 8757 - RNA, 23 nt, Homo sapiens
ugccuagacagcgucggaaggug

SEQ ID NO: 8758 - RNA, 23 nt, Homo sapiens
gccuagacagcgucggaaggugg

SEQ ID NO: 8759 - RNA, 23 nt, Homo sapiens
ccuagacagcgucggaagguggg

SEQ ID NO: 8760 - RNA, 23 nt, Homo sapiens
cuagacagcgucggaaggugggg

SEQ ID NO: 8761 - RNA, 23 nt, Homo sapiens
uagacagcgucggaagguggggg

SEQ ID NO: 8762 - RNA, 23 nt, Homo sapiens
agacagcgucggaaggugggggg

SEQ ID NO: 8763 - RNA, 23 nt, Homo sapiens
gacagcgucggaaggugggggga

SEQ ID NO: 8764 - RNA, 23 nt, Homo sapiens
acagcgucggaagguggggggag

SEQ ID NO: 8765 - RNA, 23 nt, Homo sapiens
cagcgucggaagguggggggaga

SEQ ID NO: 8766 - RNA, 23 nt, Homo sapiens
agcgucggaagguggggggagac

SEQ ID NO: 8767 - RNA, 23 nt, Homo sapiens
gcgucggaagguggggggagaca

SEQ ID NO: 8768 - RNA, 23 nt, Homo sapiens
cgucggaagguggggggagacau

SEQ ID NO: 8769 - RNA, 23 nt, Homo sapiens
gucggaagguggggggagacauu

SEQ ID NO: 8770 - RNA, 23 nt, Homo sapiens
ucggaagguggggggagacauuc

SEQ ID NO: 8771 - RNA, 23 nt, Homo sapiens
cggaagguggggggagacauuca

SEQ ID NO: 8772 - RNA, 23 nt, Homo sapiens
ggaagguggggggagacauucag

SEQ ID NO: 8773 - RNA, 23 nt, Homo sapiens
gaagguggggggagacauucagc

SEQ ID NO: 8774 - RNA, 23 nt, Homo sapiens
aagguggggggagacauucagcc

SEQ ID NO: 8775 - RNA, 23 nt, Homo sapiens
agguggggggagacauucagcca

SEQ ID NO: 8776 - RNA, 23 nt, Homo sapiens
gguggggggagacauucagccag

SEQ ID NO: 8777 - RNA, 23 nt, Homo sapiens
guggggggagacauucagccaga

SEQ ID NO: 8778 - RNA, 23 nt, Homo sapiens
uggggggagacauucagccagaa

SEQ ID NO: 8779 - RNA, 23 nt, Homo sapiens
ggggggagacauucagccagaau

SEQ ID NO: 8780 - RNA, 23 nt, Homo sapiens
gggggagacauucagccagaauu

SEQ ID NO: 8781 - RNA, 23 nt, Homo sapiens
ggggagacauucagccagaauuu

SEQ ID NO: 8782 - RNA, 23 nt, Homo sapiens
gggagacauucagccagaauuuc

SEQ ID NO: 8783 - RNA, 23 nt, Homo sapiens
ggagacauucagccagaauuuca

SEQ ID NO: 8784 - RNA, 23 nt, Homo sapiens
gagacauucagccagaauuucac

SEQ ID NO: 8785 - RNA, 23 nt, Homo sapiens
agacauucagccagaauuucacg

SEQ ID NO: 8786 - RNA, 23 nt, Homo sapiens
gacauucagccagaauuucacgg

SEQ ID NO: 8787 - RNA, 23 nt, Homo sapiens
acauucagccagaauuucacgga

SEQ ID NO: 8788 - RNA, 23 nt, Homo sapiens
cauucagccagaauuucacggaa

SEQ ID NO: 8789 - RNA, 23 nt, Homo sapiens
auucagccagaauuucacggaag

SEQ ID NO: 8790 - RNA, 23 nt, Homo sapiens
uucagccagaauuucacggaaga

SEQ ID NO: 8791 - RNA, 23 nt, Homo sapiens
ucagccagaauuucacggaagaa

SEQ ID NO: 8792 - RNA, 23 nt, Homo sapiens
cagccagaauuucacggaagaac

SEQ ID NO: 8793 - RNA, 23 nt, Homo sapiens
agccagaauuucacggaagaaca

SEQ ID NO: 8794 - RNA, 23 nt, Homo sapiens
gccagaauuucacggaagaacaa

SEQ ID NO: 8795 - RNA, 23 nt, Homo sapiens
ccagaauuucacggaagaacaag

SEQ ID NO: 8796 - RNA, 23 nt, Homo sapiens
cagaauuucacggaagaacaagg

SEQ ID NO: 8797 - RNA, 23 nt, Homo sapiens
agaauuucacggaagaacaaggg

SEQ ID NO: 8798 - RNA, 23 nt, Homo sapiens
gaauuucacggaagaacaagggc

SEQ ID NO: 8799 - RNA, 23 nt, Homo sapiens
aauuucacggaagaacaagggca

SEQ ID NO: 8800 - RNA, 23 nt, Homo sapiens
auuucacggaagaacaagggcac

SEQ ID NO: 8801 - RNA, 23 nt, Homo sapiens
uuucacggaagaacaagggcaca

SEQ ID NO: 8802 - RNA, 23 nt, Homo sapiens
uucacggaagaacaagggcacag

SEQ ID NO: 8803 - RNA, 23 nt, Homo sapiens
ucacggaagaacaagggcacaga

SEQ ID NO: 8804 - RNA, 23 nt, Homo sapiens
cacggaagaacaagggcacagag

SEQ ID NO: 8805 - RNA, 23 nt, Homo sapiens
acggaagaacaagggcacagaga

SEQ ID NO: 8806 - RNA, 23 nt, Homo sapiens
cggaagaacaagggcacagagag

SEQ ID NO: 8807 - RNA, 23 nt, Homo sapiens
ggaagaacaagggcacagagagg

SEQ ID NO: 8808 - RNA, 23 nt, Homo sapiens
gaagaacaagggcacagagaggc

SEQ ID NO: 8809 - RNA, 23 nt, Homo sapiens
aagaacaagggcacagagaggcc

SEQ ID NO: 8810 - RNA, 23 nt, Homo sapiens
agaacaagggcacagagaggcca

SEQ ID NO: 8811 - RNA, 23 nt, Homo sapiens
gaacaagggcacagagaggccag

SEQ ID NO: 8812 - RNA, 23 nt, Homo sapiens
aacaagggcacagagaggccagc

SEQ ID NO: 8813 - RNA, 23 nt, Homo sapiens
acaagggcacagagaggccagcg

SEQ ID NO: 8814 - RNA, 23 nt, Homo sapiens
caagggcacagagaggccagcga

SEQ ID NO: 8815 - RNA, 23 nt, Homo sapiens
aagggcacagagaggccagcgag

SEQ ID NO: 8816 - RNA, 23 nt, Homo sapiens
agggcacagagaggccagcgagc

SEQ ID NO: 8817 - RNA, 23 nt, Homo sapiens
gggcacagagaggccagcgagcu

SEQ ID NO: 8818 - RNA, 23 nt, Homo sapiens
ggcacagagaggccagcgagcuc

SEQ ID NO: 8819 - RNA, 23 nt, Homo sapiens
gcacagagaggccagcgagcucc

SEQ ID NO: 8820 - RNA, 23 nt, Homo sapiens
cacagagaggccagcgagcuccc

SEQ ID NO: 8821 - RNA, 23 nt, Homo sapiens
acagagaggccagcgagcucccu

SEQ ID NO: 8822 - RNA, 23 nt, Homo sapiens
cagagaggccagcgagcucccuu

SEQ ID NO: 8823 - RNA, 23 nt, Homo sapiens
agagaggccagcgagcucccuug

SEQ ID NO: 8824 - RNA, 23 nt, Homo sapiens
gagaggccagcgagcucccuugc

SEQ ID NO: 8825 - RNA, 23 nt, Homo sapiens
agaggccagcgagcucccuugca

SEQ ID NO: 8826 - RNA, 23 nt, Homo sapiens
gaggccagcgagcucccuugcac

SEQ ID NO: 8827 - RNA, 23 nt, Homo sapiens
aggccagcgagcucccuugcacg

SEQ ID NO: 8828 - RNA, 23 nt, Homo sapiens
ggccagcgagcucccuugcacgu

SEQ ID NO: 8829 - RNA, 23 nt, Homo sapiens
gccagcgagcucccuugcacguc

SEQ ID NO: 8830 - RNA, 23 nt, Homo sapiens
ccagcgagcucccuugcacguca

SEQ ID NO: 8831 - RNA, 23 nt, Homo sapiens
cagcgagcucccuugcacgucag

SEQ ID NO: 8832 - RNA, 23 nt, Homo sapiens
agcgagcucccuugcacgucagc

SEQ ID NO: 8833 - RNA, 23 nt, Homo sapiens
gcgagcucccuugcacgucagcc

SEQ ID NO: 8834 - RNA, 23 nt, Homo sapiens
cgagcucccuugcacgucagccg

SEQ ID NO: 8835 - RNA, 23 nt, Homo sapiens
gagcucccuugcacgucagccgg

SEQ ID NO: 8836 - RNA, 23 nt, Homo sapiens
agcucccuugcacgucagccggg

SEQ ID NO: 8837 - RNA, 23 nt, Homo sapiens
gcucccuugcacgucagccgggg

SEQ ID NO: 8838 - RNA, 23 nt, Homo sapiens
cucccuugcacgucagccggggu

SEQ ID NO: 8839 - RNA, 23 nt, Homo sapiens
ucccuugcacgucagccggggug

SEQ ID NO: 8840 - RNA, 23 nt, Homo sapiens
cccuugcacgucagccggggugc

SEQ ID NO: 8841 - RNA, 23 nt, Homo sapiens
ccuugcacgucagccggggugcg

SEQ ID NO: 8842 - RNA, 23 nt, Homo sapiens
cuugcacgucagccggggugcgc

SEQ ID NO: 8843 - RNA, 23 nt, Homo sapiens
uugcacgucagccggggugcgca

SEQ ID NO: 8844 - RNA, 23 nt, Homo sapiens
ugcacgucagccggggugcgcac

SEQ ID NO: 8845 - RNA, 23 nt, Homo sapiens
gcacgucagccggggugcgcacu

SEQ ID NO: 8846 - RNA, 23 nt, Homo sapiens
cacgucagccggggugcgcacug

SEQ ID NO: 8847 - RNA, 23 nt, Homo sapiens
acgucagccggggugcgcacugc

SEQ ID NO: 8848 - RNA, 23 nt, Homo sapiens
cgucagccggggugcgcacugcg

SEQ ID NO: 8849 - RNA, 23 nt, Homo sapiens
gucagccggggugcgcacugcgc

SEQ ID NO: 8850 - RNA, 23 nt, Homo sapiens
ucagccggggugcgcacugcgcg

SEQ ID NO: 8851 - RNA, 23 nt, Homo sapiens
cagccggggugcgcacugcgcgc

SEQ ID NO: 8852 - RNA, 23 nt, Homo sapiens
agccggggugcgcacugcgcgca

SEQ ID NO: 8853 - RNA, 23 nt, Homo sapiens
gccggggugcgcacugcgcgcag

SEQ ID NO: 8854 - RNA, 23 nt, Homo sapiens
ccggggugcgcacugcgcgcagg

SEQ ID NO: 8855 - RNA, 23 nt, Homo sapiens
cggggugcgcacugcgcgcaggu

SEQ ID NO: 8856 - RNA, 23 nt, Homo sapiens
ggggugcgcacugcgcgcagguc

SEQ ID NO: 8857 - RNA, 23 nt, Homo sapiens
gggugcgcacugcgcgcaggucu

SEQ ID NO: 8858 - RNA, 23 nt, Homo sapiens
ggugcgcacugcgcgcaggucua

SEQ ID NO: 8859 - RNA, 23 nt, Homo sapiens
gugcgcacugcgcgcaggucuag

SEQ ID NO: 8860 - RNA, 23 nt, Homo sapiens
ugcgcacugcgcgcaggucuagc

SEQ ID NO: 8861 - RNA, 23 nt, Homo sapiens
gcgcacugcgcgcaggucuagcc

SEQ ID NO: 8862 - RNA, 23 nt, Homo sapiens
cgcacugcgcgcaggucuagcca

SEQ ID NO: 8863 - RNA, 23 nt, Homo sapiens
gcacugcgcgcaggucuagccag

SEQ ID NO: 8864 - RNA, 23 nt, Homo sapiens
cacugcgcgcaggucuagccagg

SEQ ID NO: 8865 - RNA, 23 nt, Homo sapiens
acugcgcgcaggucuagccagga

SEQ ID NO: 8866 - RNA, 23 nt, Homo sapiens
cugcgcgcaggucuagccaggaa

SEQ ID NO: 8867 - RNA, 23 nt, Homo sapiens
ugcgcgcaggucuagccaggaag

SEQ ID NO: 8868 - RNA, 23 nt, Homo sapiens
gcgcgcaggucuagccaggaagc

SEQ ID NO: 8869 - RNA, 23 nt, Homo sapiens
cgcgcaggucuagccaggaagcg

SEQ ID NO: 8870 - RNA, 23 nt, Homo sapiens
gcgcaggucuagccaggaagcgg

SEQ ID NO: 8871 - RNA, 23 nt, Homo sapiens
cgcaggucuagccaggaagcggg

SEQ ID NO: 8872 - RNA, 23 nt, Homo sapiens
gcaggucuagccaggaagcgggc

SEQ ID NO: 8873 - RNA, 23 nt, Homo sapiens
caggucuagccaggaagcgggca

SEQ ID NO: 8874 - RNA, 23 nt, Homo sapiens
aggucuagccaggaagcgggcaa

SEQ ID NO: 8875 - RNA, 23 nt, Homo sapiens
ggucuagccaggaagcgggcaaa

SEQ ID NO: 8876 - RNA, 23 nt, Homo sapiens
gucuagccaggaagcgggcaaag

SEQ ID NO: 8877 - RNA, 23 nt, Homo sapiens
ucuagccaggaagcgggcaaaga

SEQ ID NO: 8878 - RNA, 23 nt, Homo sapiens
cuagccaggaagcgggcaaagac

SEQ ID NO: 8879 - RNA, 23 nt, Homo sapiens
uagccaggaagcgggcaaagaca

SEQ ID NO: 8880 - RNA, 23 nt, Homo sapiens
agccaggaagcgggcaaagacag

SEQ ID NO: 8881 - RNA, 23 nt, Homo sapiens
gccaggaagcgggcaaagacaga

SEQ ID NO: 8882 - RNA, 23 nt, Homo sapiens
ccaggaagcgggcaaagacagac

SEQ ID NO: 8883 - RNA, 23 nt, Homo sapiens
caggaagcgggcaaagacagaca

SEQ ID NO: 8884 - RNA, 23 nt, Homo sapiens
aggaagcgggcaaagacagacag

SEQ ID NO: 8885 - RNA, 23 nt, Homo sapiens
ggaagcgggcaaagacagacaga

SEQ ID NO: 8886 - RNA, 23 nt, Homo sapiens
gaagcgggcaaagacagacagag

SEQ ID NO: 8887 - RNA, 23 nt, Homo sapiens
aagcgggcaaagacagacagagg

SEQ ID NO: 8888 - RNA, 23 nt, Homo sapiens
agcgggcaaagacagacagaggu

SEQ ID NO: 8889 - RNA, 23 nt, Homo sapiens
gcgggcaaagacagacagaggua

SEQ ID NO: 8890 - RNA, 23 nt, Homo sapiens
cgggcaaagacagacagagguau

SEQ ID NO: 8891 - RNA, 23 nt, Homo sapiens
gggcaaagacagacagagguaug

SEQ ID NO: 8892 - RNA, 23 nt, Homo sapiens
ggcaaagacagacagagguaugc

SEQ ID NO: 8893 - RNA, 23 nt, Homo sapiens
gcaaagacagacagagguaugcu

SEQ ID NO: 8894 - RNA, 23 nt, Homo sapiens
caaagacagacagagguaugcuu

SEQ ID NO: 8895 - RNA, 23 nt, Homo sapiens
aaagacagacagagguaugcuuu

SEQ ID NO: 8896 - RNA, 23 nt, Homo sapiens
aagacagacagagguaugcuuuu

SEQ ID NO: 8897 - RNA, 23 nt, Homo sapiens
agacagacagagguaugcuuuug

SEQ ID NO: 8898 - RNA, 23 nt, Homo sapiens
gacagacagagguaugcuuuuga

SEQ ID NO: 8899 - RNA, 23 nt, Homo sapiens
acagacagagguaugcuuuugac

SEQ ID NO: 8900 - RNA, 23 nt, Homo sapiens
cagacagagguaugcuuuugacc

SEQ ID NO: 8901 - RNA, 23 nt, Homo sapiens
agacagagguaugcuuuugaccg

SEQ ID NO: 8902 - RNA, 23 nt, Homo sapiens
gacagagguaugcuuuugaccgc

SEQ ID NO: 8903 - RNA, 23 nt, Homo sapiens
acagagguaugcuuuugaccgcc

SEQ ID NO: 8904 - RNA, 23 nt, Homo sapiens
cagagguaugcuuuugaccgcca

SEQ ID NO: 8905 - RNA, 23 nt, Homo sapiens
agagguaugcuuuugaccgccag

SEQ ID NO: 8906 - RNA, 23 nt, Homo sapiens
gagguaugcuuuugaccgccagg

SEQ ID NO: 8907 - RNA, 23 nt, Homo sapiens
agguaugcuuuugaccgccagga

SEQ ID NO: 8908 - RNA, 23 nt, Homo sapiens
gguaugcuuuugaccgccaggag

SEQ ID NO: 8909 - RNA, 23 nt, Homo sapiens
guaugcuuuugaccgccaggagc

SEQ ID NO: 8910 - RNA, 23 nt, Homo sapiens
uaugcuuuugaccgccaggagcu

SEQ ID NO: 8911 - RNA, 23 nt, Homo sapiens
augcuuuugaccgccaggagcuc

SEQ ID NO: 8912 - RNA, 23 nt, Homo sapiens
ugcuuuugaccgccaggagcucc

SEQ ID NO: 8913 - RNA, 23 nt, Homo sapiens
gcuuuugaccgccaggagcuccg

SEQ ID NO: 8914 - RNA, 23 nt, Homo sapiens
cuuuugaccgccaggagcuccgc

SEQ ID NO: 8915 - RNA, 23 nt, Homo sapiens
uuuugaccgccaggagcuccgcg

SEQ ID NO: 8916 - RNA, 23 nt, Homo sapiens
uuugaccgccaggagcuccgcgc

SEQ ID NO: 8917 - RNA, 23 nt, Homo sapiens
uugaccgccaggagcuccgcgcu

SEQ ID NO: 8918 - RNA, 23 nt, Homo sapiens
ugaccgccaggagcuccgcgcug

SEQ ID NO: 8919 - RNA, 23 nt, Homo sapiens
gaccgccaggagcuccgcgcugg

SEQ ID NO: 8920 - RNA, 23 nt, Homo sapiens
accgccaggagcuccgcgcuggc

SEQ ID NO: 8921 - RNA, 23 nt, Homo sapiens
ccgccaggagcuccgcgcuggca

SEQ ID NO: 8922 - RNA, 23 nt, Homo sapiens
cgccaggagcuccgcgcuggcag

SEQ ID NO: 8923 - RNA, 23 nt, Homo sapiens
gccaggagcuccgcgcuggcagc

SEQ ID NO: 8924 - RNA, 23 nt, Homo sapiens
ccaggagcuccgcgcuggcagcu

SEQ ID NO: 8925 - RNA, 23 nt, Homo sapiens
caggagcuccgcgcuggcagcug

SEQ ID NO: 8926 - RNA, 23 nt, Homo sapiens
aggagcuccgcgcuggcagcugg

SEQ ID NO: 8927 - RNA, 23 nt, Homo sapiens
ggagcuccgcgcuggcagcuggg

SEQ ID NO: 8928 - RNA, 23 nt, Homo sapiens
gagcuccgcgcuggcagcuggga

SEQ ID NO: 8929 - RNA, 23 nt, Homo sapiens
agcuccgcgcuggcagcugggag

SEQ ID NO: 8930 - RNA, 23 nt, Homo sapiens
gcuccgcgcuggcagcugggagg

SEQ ID NO: 8931 - RNA, 23 nt, Homo sapiens
cuccgcgcuggcagcugggaggc

SEQ ID NO: 8932 - RNA, 23 nt, Homo sapiens
uccgcgcuggcagcugggaggcu

SEQ ID NO: 8933 - RNA, 23 nt, Homo sapiens
ccgcgcuggcagcugggaggcug

SEQ ID NO: 8934 - RNA, 23 nt, Homo sapiens
cgcgcuggcagcugggaggcugc

SEQ ID NO: 8935 - RNA, 23 nt, Homo sapiens
gcgcuggcagcugggaggcugca

SEQ ID NO: 8936 - RNA, 23 nt, Homo sapiens
cgcuggcagcugggaggcugcag

SEQ ID NO: 8937 - RNA, 23 nt, Homo sapiens
gcuggcagcugggaggcugcagg

SEQ ID NO: 8938 - RNA, 23 nt, Homo sapiens
cuggcagcugggaggcugcaggg

SEQ ID NO: 8939 - RNA, 23 nt, Homo sapiens
uggcagcugggaggcugcagggg

SEQ ID NO: 8940 - RNA, 23 nt, Homo sapiens
ggcagcugggaggcugcaggggc

SEQ ID NO: 8941 - RNA, 23 nt, Homo sapiens
gcagcugggaggcugcaggggcc

SEQ ID NO: 8942 - RNA, 23 nt, Homo sapiens
cagcugggaggcugcaggggccc

SEQ ID NO: 8943 - RNA, 23 nt, Homo sapiens
agcugggaggcugcaggggcccg

SEQ ID NO: 8944 - RNA, 23 nt, Homo sapiens
gcugggaggcugcaggggcccgg

SEQ ID NO: 8945 - RNA, 23 nt, Homo sapiens
cugggaggcugcaggggcccggg

SEQ ID NO: 8946 - RNA, 23 nt, Homo sapiens
ugggaggcugcaggggcccgggc

SEQ ID NO: 8947 - RNA, 23 nt, Homo sapiens
gggaggcugcaggggcccgggcg

SEQ ID NO: 8948 - RNA, 23 nt, Homo sapiens
ggaggcugcaggggcccgggcgg

SEQ ID NO: 8949 - RNA, 23 nt, Homo sapiens
gaggcugcaggggcccgggcggg

SEQ ID NO: 8950 - RNA, 23 nt, Homo sapiens
aggcugcaggggcccgggcgggc

SEQ ID NO: 8951 - RNA, 23 nt, Homo sapiens
ggcugcaggggcccgggcgggcg

SEQ ID NO: 8952 - RNA, 23 nt, Homo sapiens
gcugcaggggcccgggcgggcgg

SEQ ID NO: 8953 - RNA, 23 nt, Homo sapiens
cugcaggggcccgggcgggcggg

SEQ ID NO: 8954 - RNA, 23 nt, Homo sapiens
ugcaggggcccgggcgggcgggc

SEQ ID NO: 8955 - RNA, 23 nt, Homo sapiens
gcaggggcccgggcgggcgggcg

SEQ ID NO: 8956 - RNA, 23 nt, Homo sapiens
caggggcccgggcgggcgggcga

SEQ ID NO: 8957 - RNA, 23 nt, Homo sapiens
aggggcccgggcgggcgggcgac

SEQ ID NO: 8958 - RNA, 23 nt, Homo sapiens
ggggcccgggcgggcgggcgacg

SEQ ID NO: 8959 - RNA, 23 nt, Homo sapiens
gggcccgggcgggcgggcgacgg

SEQ ID NO: 8960 - RNA, 23 nt, Homo sapiens
ggcccgggcgggcgggcgacggu

SEQ ID NO: 8961 - RNA, 23 nt, Homo sapiens
gcccgggcgggcgggcgacggug

SEQ ID NO: 8962 - RNA, 23 nt, Homo sapiens
cccgggcgggcgggcgacggugg

SEQ ID NO: 8963 - RNA, 23 nt, Homo sapiens
ccgggcgggcgggcgacgguggc

SEQ ID NO: 8964 - RNA, 23 nt, Homo sapiens
cgggcgggcgggcgacgguggcg

SEQ ID NO: 8965 - RNA, 23 nt, Homo sapiens
gggcgggcgggcgacgguggcgc

SEQ ID NO: 8966 - RNA, 23 nt, Homo sapiens
ggcgggcgggcgacgguggcgcg

SEQ ID NO: 8967 - RNA, 23 nt, Homo sapiens
gcgggcgggcgacgguggcgcgg

SEQ ID NO: 8968 - RNA, 23 nt, Homo sapiens
cgggcgggcgacgguggcgcggg

SEQ ID NO: 8969 - RNA, 23 nt, Homo sapiens
gggcgggcgacgguggcgcgggg

SEQ ID NO: 8970 - RNA, 23 nt, Homo sapiens
ggcgggcgacgguggcgcggggg

SEQ ID NO: 8971 - RNA, 23 nt, Homo sapiens
gcgggcgacgguggcgcgggggc

SEQ ID NO: 8972 - RNA, 23 nt, Homo sapiens
cgggcgacgguggcgcgggggca

SEQ ID NO: 8973 - RNA, 23 nt, Homo sapiens
gggcgacgguggcgcgggggcac

SEQ ID NO: 8974 - RNA, 23 nt, Homo sapiens
ggcgacgguggcgcgggggcaca

SEQ ID NO: 8975 - RNA, 23 nt, Homo sapiens
gcgacgguggcgcgggggcacac

SEQ ID NO: 8976 - RNA, 23 nt, Homo sapiens
cgacgguggcgcgggggcacaca

SEQ ID NO: 8977 - RNA, 23 nt, Homo sapiens
gacgguggcgcgggggcacacag

SEQ ID NO: 8978 - RNA, 23 nt, Homo sapiens
acgguggcgcgggggcacacagg

SEQ ID NO: 8979 - RNA, 23 nt, Homo sapiens
cgguggcgcgggggcacacagga

SEQ ID NO: 8980 - RNA, 23 nt, Homo sapiens
gguggcgcgggggcacacaggag

SEQ ID NO: 8981 - RNA, 23 nt, Homo sapiens
guggcgcgggggcacacaggagg

SEQ ID NO: 8982 - RNA, 23 nt, Homo sapiens
uggcgcgggggcacacaggaggc

SEQ ID NO: 8983 - RNA, 23 nt, Homo sapiens
ggcgcgggggcacacaggaggcg

SEQ ID NO: 8984 - RNA, 23 nt, Homo sapiens
gcgcgggggcacacaggaggcga

SEQ ID NO: 8985 - RNA, 23 nt, Homo sapiens
cgcgggggcacacaggaggcgag

SEQ ID NO: 8986 - RNA, 23 nt, Homo sapiens
gcgggggcacacaggaggcgagc

SEQ ID NO: 8987 - RNA, 23 nt, Homo sapiens
cgggggcacacaggaggcgagcc

SEQ ID NO: 8988 - RNA, 23 nt, Homo sapiens
gggggcacacaggaggcgagccg

SEQ ID NO: 8989 - RNA, 23 nt, Homo sapiens
ggggcacacaggaggcgagccgc

SEQ ID NO: 8990 - RNA, 23 nt, Homo sapiens
gggcacacaggaggcgagccgcc

SEQ ID NO: 8991 - RNA, 23 nt, Homo sapiens
ggcacacaggaggcgagccgccg

SEQ ID NO: 8992 - RNA, 23 nt, Homo sapiens
gcacacaggaggcgagccgccgg

SEQ ID NO: 8993 - RNA, 23 nt, Homo sapiens
cacacaggaggcgagccgccgga

SEQ ID NO: 8994 - RNA, 23 nt, Homo sapiens
acacaggaggcgagccgccggag

SEQ ID NO: 8995 - RNA, 23 nt, Homo sapiens
cacaggaggcgagccgccggagc

SEQ ID NO: 8996 - RNA, 23 nt, Homo sapiens
acaggaggcgagccgccggagcg

SEQ ID NO: 8997 - RNA, 23 nt, Homo sapiens
caggaggcgagccgccggagcgg

SEQ ID NO: 8998 - RNA, 23 nt, Homo sapiens
aggaggcgagccgccggagcgga

SEQ ID NO: 8999 - RNA, 23 nt, Homo sapiens
ggaggcgagccgccggagcggag

SEQ ID NO: 9000 - RNA, 23 nt, Homo sapiens
gaggcgagccgccggagcggagu

SEQ ID NO: 9001 - RNA, 23 nt, Homo sapiens
aggcgagccgccggagcggaguc

SEQ ID NO: 9002 - RNA, 23 nt, Homo sapiens
ggcgagccgccggagcggaguca

SEQ ID NO: 9003 - RNA, 23 nt, Homo sapiens
gcgagccgccggagcggagucag

SEQ ID NO: 9004 - RNA, 23 nt, Homo sapiens
cgagccgccggagcggagucagg

SEQ ID NO: 9005 - RNA, 23 nt, Homo sapiens
gagccgccggagcggagucaggc

SEQ ID NO: 9006 - RNA, 23 nt, Homo sapiens
agccgccggagcggagucaggcc

SEQ ID NO: 9007 - RNA, 23 nt, Homo sapiens
gccgccggagcggagucaggccc

SEQ ID NO: 9008 - RNA, 23 nt, Homo sapiens
ccgccggagcggagucaggcccg

SEQ ID NO: 9009 - RNA, 23 nt, Homo sapiens
cgccggagcggagucaggcccgg

SEQ ID NO: 9010 - RNA, 23 nt, Homo sapiens
gccggagcggagucaggcccgga

SEQ ID NO: 9011 - RNA, 23 nt, Homo sapiens
ccggagcggagucaggcccggac

SEQ ID NO: 9012 - RNA, 23 nt, Homo sapiens
cggagcggagucaggcccggacg

SEQ ID NO: 9013 - RNA, 23 nt, Homo sapiens
ggagcggagucaggcccggacgc

SEQ ID NO: 9014 - RNA, 23 nt, Homo sapiens
gagcggagucaggcccggacgcu

SEQ ID NO: 9015 - RNA, 23 nt, Homo sapiens
agcggagucaggcccggacgcug

SEQ ID NO: 9016 - RNA, 23 nt, Homo sapiens
gcggagucaggcccggacgcugc

SEQ ID NO: 9017 - RNA, 23 nt, Homo sapiens
cggagucaggcccggacgcugcg

SEQ ID NO: 9018 - RNA, 23 nt, Homo sapiens
ggagucaggcccggacgcugcgc

SEQ ID NO: 9019 - RNA, 23 nt, Homo sapiens
gagucaggcccggacgcugcgcg

SEQ ID NO: 9020 - RNA, 23 nt, Homo sapiens
agucaggcccggacgcugcgcgg

SEQ ID NO: 9021 - RNA, 23 nt, Homo sapiens
gucaggcccggacgcugcgcggg

SEQ ID NO: 9022 - RNA, 23 nt, Homo sapiens
ucaggcccggacgcugcgcgggg

SEQ ID NO: 9023 - RNA, 23 nt, Homo sapiens
caggcccggacgcugcgcggggc

SEQ ID NO: 9024 - RNA, 23 nt, Homo sapiens
aggcccggacgcugcgcggggcc

SEQ ID NO: 9025 - RNA, 23 nt, Homo sapiens
ggcccggacgcugcgcggggccc

SEQ ID NO: 9026 - RNA, 23 nt, Homo sapiens
gcccggacgcugcgcggggcccg

SEQ ID NO: 9027 - RNA, 23 nt, Homo sapiens
cccggacgcugcgcggggcccgg

SEQ ID NO: 9028 - RNA, 23 nt, Homo sapiens
ccggacgcugcgcggggcccggu

SEQ ID NO: 9029 - RNA, 23 nt, Homo sapiens
cggacgcugcgcggggcccggug

SEQ ID NO: 9030 - RNA, 23 nt, Homo sapiens
ggacgcugcgcggggcccggugu

SEQ ID NO: 9031 - RNA, 23 nt, Homo sapiens
gacgcugcgcggggcccgguguu

SEQ ID NO: 9032 - RNA, 23 nt, Homo sapiens
acgcugcgcggggcccgguguuu

SEQ ID NO: 9033 - RNA, 23 nt, Homo sapiens
cgcugcgcggggcccgguguuuc

SEQ ID NO: 9034 - RNA, 23 nt, Homo sapiens
gcugcgcggggcccgguguuucg

SEQ ID NO: 9035 - RNA, 23 nt, Homo sapiens
cugcgcggggcccgguguuucgc

SEQ ID NO: 9036 - RNA, 23 nt, Homo sapiens
ugcgcggggcccgguguuucgcg

SEQ ID NO: 9037 - RNA, 23 nt, Homo sapiens
gcgcggggcccgguguuucgcgg

SEQ ID NO: 9038 - RNA, 23 nt, Homo sapiens
cgcggggcccgguguuucgcggg

SEQ ID NO: 9039 - RNA, 23 nt, Homo sapiens
gcggggcccgguguuucgcggga

SEQ ID NO: 9040 - RNA, 23 nt, Homo sapiens
cggggcccgguguuucgcgggac

SEQ ID NO: 9041 - RNA, 23 nt, Homo sapiens
ggggcccgguguuucgcgggacg

SEQ ID NO: 9042 - RNA, 23 nt, Homo sapiens
gggcccgguguuucgcgggacgg

SEQ ID NO: 9043 - RNA, 23 nt, Homo sapiens
ggcccgguguuucgcgggacggg

SEQ ID NO: 9044 - RNA, 23 nt, Homo sapiens
gcccgguguuucgcgggacgggg

SEQ ID NO: 9045 - RNA, 23 nt, Homo sapiens
cccgguguuucgcgggacggggg

SEQ ID NO: 9046 - RNA, 23 nt, Homo sapiens
ccgguguuucgcgggacgggggu

SEQ ID NO: 9047 - RNA, 23 nt, Homo sapiens
cgguguuucgcgggacggggguc

SEQ ID NO: 9048 - RNA, 23 nt, Homo sapiens
gguguuucgcgggacgggggucu

SEQ ID NO: 9049 - RNA, 23 nt, Homo sapiens
guguuucgcgggacgggggucuc

SEQ ID NO: 9050 - RNA, 23 nt, Homo sapiens
uguuucgcgggacgggggucucc

SEQ ID NO: 9051 - RNA, 23 nt, Homo sapiens
guuucgcgggacgggggucucca

SEQ ID NO: 9052 - RNA, 23 nt, Homo sapiens
uuucgcgggacgggggucuccac

SEQ ID NO: 9053 - RNA, 23 nt, Homo sapiens
uucgcgggacgggggucuccacc

SEQ ID NO: 9054 - RNA, 23 nt, Homo sapiens
ucgcgggacgggggucuccaccc

SEQ ID NO: 9055 - RNA, 23 nt, Homo sapiens
cgcgggacgggggucuccaccca

SEQ ID NO: 9056 - RNA, 23 nt, Homo sapiens
gcgggacgggggucuccacccag

SEQ ID NO: 9057 - RNA, 23 nt, Homo sapiens
cgggacgggggucuccacccagc

SEQ ID NO: 9058 - RNA, 23 nt, Homo sapiens
gggacgggggucuccacccagcc

SEQ ID NO: 9059 - RNA, 23 nt, Homo sapiens
ggacgggggucuccacccagccc

SEQ ID NO: 9060 - RNA, 23 nt, Homo sapiens
gacgggggucuccacccagccca

SEQ ID NO: 9061 - RNA, 23 nt, Homo sapiens
acgggggucuccacccagcccag

SEQ ID NO: 9062 - RNA, 23 nt, Homo sapiens
cgggggucuccacccagcccagg

SEQ ID NO: 9063 - RNA, 23 nt, Homo sapiens
gggggucuccacccagcccaggg

SEQ ID NO: 9064 - RNA, 23 nt, Homo sapiens
ggggucuccacccagcccagggg

SEQ ID NO: 9065 - RNA, 23 nt, Homo sapiens
gggucuccacccagcccagggga

SEQ ID NO: 9066 - RNA, 23 nt, Homo sapiens
ggucuccacccagcccaggggac

SEQ ID NO: 9067 - RNA, 23 nt, Homo sapiens
gucuccacccagcccaggggacg

SEQ ID NO: 9068 - RNA, 23 nt, Homo sapiens
ucuccacccagcccaggggacga

SEQ ID NO: 9069 - RNA, 23 nt, Homo sapiens
cuccacccagcccaggggacgac

SEQ ID NO: 9070 - RNA, 23 nt, Homo sapiens
uccacccagcccaggggacgacg

SEQ ID NO: 9071 - RNA, 23 nt, Homo sapiens
ccacccagcccaggggacgacgc

SEQ ID NO: 9072 - RNA, 23 nt, Homo sapiens
cacccagcccaggggacgacgcg

SEQ ID NO: 9073 - RNA, 23 nt, Homo sapiens
acccagcccaggggacgacgcgu

SEQ ID NO: 9074 - RNA, 23 nt, Homo sapiens
cccagcccaggggacgacgcguu

SEQ ID NO: 9075 - RNA, 23 nt, Homo sapiens
ccagcccaggggacgacgcguuu

SEQ ID NO: 9076 - RNA, 23 nt, Homo sapiens
cagcccaggggacgacgcguuuu

SEQ ID NO: 9077 - RNA, 23 nt, Homo sapiens
agcccaggggacgacgcguuuuc

SEQ ID NO: 9078 - RNA, 23 nt, Homo sapiens
gcccaggggacgacgcguuuucc

SEQ ID NO: 9079 - RNA, 23 nt, Homo sapiens
cccaggggacgacgcguuuuccg

SEQ ID NO: 9080 - RNA, 23 nt, Homo sapiens
ccaggggacgacgcguuuuccgg

SEQ ID NO: 9081 - RNA, 23 nt, Homo sapiens
caggggacgacgcguuuuccggg

SEQ ID NO: 9082 - RNA, 23 nt, Homo sapiens
aggggacgacgcguuuuccgggg

SEQ ID NO: 9083 - RNA, 23 nt, Homo sapiens
ggggacgacgcguuuuccggggg

SEQ ID NO: 9084 - RNA, 23 nt, Homo sapiens
gggacgacgcguuuuccgggggu

SEQ ID NO: 9085 - RNA, 23 nt, Homo sapiens
ggacgacgcguuuuccgggggug

SEQ ID NO: 9086 - RNA, 23 nt, Homo sapiens
gacgacgcguuuuccgggggugg

SEQ ID NO: 9087 - RNA, 23 nt, Homo sapiens
acgacgcguuuuccggggguggg

SEQ ID NO: 9088 - RNA, 23 nt, Homo sapiens
cgacgcguuuuccgggggugggg

SEQ ID NO: 9089 - RNA, 23 nt, Homo sapiens
gacgcguuuuccggggguggggg

SEQ ID NO: 9090 - RNA, 23 nt, Homo sapiens
acgcguuuuccgggggugggggg

SEQ ID NO: 9091 - RNA, 23 nt, Homo sapiens
cgcguuuuccggggguggggggu

SEQ ID NO: 9092 - RNA, 23 nt, Homo sapiens
gcguuuuccggggguggggggug

SEQ ID NO: 9093 - RNA, 23 nt, Homo sapiens
cguuuuccggggguggggggugg

SEQ ID NO: 9094 - RNA, 23 nt, Homo sapiens
guuuuccgggggugggggguggg

SEQ ID NO: 9095 - RNA, 23 nt, Homo sapiens
uuuuccggggguggggggugggg

SEQ ID NO: 9096 - RNA, 23 nt, Homo sapiens
uuuccgggggugggggguggggg

SEQ ID NO: 9097 - RNA, 23 nt, Homo sapiens
uuccggggguggggggugggggg

SEQ ID NO: 9098 - RNA, 23 nt, Homo sapiens
uccgggggugggggguggggggu

SEQ ID NO: 9099 - RNA, 23 nt, Homo sapiens
ccgggggugggggguggggggug

SEQ ID NO: 9100 - RNA, 23 nt, Homo sapiens
cgggggugggggguggggggugg

SEQ ID NO: 9101 - RNA, 23 nt, Homo sapiens
ggggguggggggugggggguggg

SEQ ID NO: 9102 - RNA, 23 nt, Homo sapiens
ggggugggggguggggggugggg

SEQ ID NO: 9103 - RNA, 23 nt, Homo sapiens
gggugggggguggggggugggga

SEQ ID NO: 9104 - RNA, 23 nt, Homo sapiens
gguggggggugggggguggggag

SEQ ID NO: 9105 - RNA, 23 nt, Homo sapiens
guggggggugggggguggggagg

SEQ ID NO: 9106 - RNA, 23 nt, Homo sapiens
uggggggugggggguggggaggg

SEQ ID NO: 9107 - RNA, 23 nt, Homo sapiens
ggggggugggggguggggagggg

SEQ ID NO: 9108 - RNA, 23 nt, Homo sapiens
gggggugggggguggggaggggg

SEQ ID NO: 9109 - RNA, 23 nt, Homo sapiens
ggggugggggguggggagggggc

SEQ ID NO: 9110 - RNA, 23 nt, Homo sapiens
gggugggggguggggagggggcg

SEQ ID NO: 9111 - RNA, 23 nt, Homo sapiens
ggugggggguggggagggggcgg

SEQ ID NO: 9112 - RNA, 23 nt, Homo sapiens
gugggggguggggagggggcggu

SEQ ID NO: 9113 - RNA, 23 nt, Homo sapiens
ugggggguggggagggggcgguc

SEQ ID NO: 9114 - RNA, 23 nt, Homo sapiens
gggggguggggagggggcgguca

SEQ ID NO: 9115 - RNA, 23 nt, Homo sapiens
ggggguggggagggggcggucag

SEQ ID NO: 9116 - RNA, 23 nt, Homo sapiens
gggguggggagggggcggucagg

SEQ ID NO: 9117 - RNA, 23 nt, Homo sapiens
ggguggggagggggcggucaggc

SEQ ID NO: 9118 - RNA, 23 nt, Homo sapiens
gguggggagggggcggucaggcg

SEQ ID NO: 9119 - RNA, 23 nt, Homo sapiens
guggggagggggcggucaggcgg

SEQ ID NO: 9120 - RNA, 23 nt, Homo sapiens
uggggagggggcggucaggcggc

SEQ ID NO: 9121 - RNA, 23 nt, Homo sapiens
ggggagggggcggucaggcggcg

SEQ ID NO: 9122 - RNA, 23 nt, Homo sapiens
gggagggggcggucaggcggcgg

SEQ ID NO: 9123 - RNA, 23 nt, Homo sapiens
ggagggggcggucaggcggcggg

SEQ ID NO: 9124 - RNA, 23 nt, Homo sapiens
gagggggcggucaggcggcgggg

SEQ ID NO: 9125 - RNA, 23 nt, Homo sapiens
agggggcggucaggcggcggggu

SEQ ID NO: 9126 - RNA, 23 nt, Homo sapiens
gggggcggucaggcggcggggug

SEQ ID NO: 9127 - RNA, 23 nt, Homo sapiens
ggggcggucaggcggcggggugg

SEQ ID NO: 9128 - RNA, 23 nt, Homo sapiens
gggcggucaggcggcgggguggg

SEQ ID NO: 9129 - RNA, 23 nt, Homo sapiens
ggcggucaggcggcggggugggc

SEQ ID NO: 9130 - RNA, 23 nt, Homo sapiens
gcggucaggcggcggggugggcu

SEQ ID NO: 9131 - RNA, 23 nt, Homo sapiens
cggucaggcggcggggugggcug

SEQ ID NO: 9132 - RNA, 23 nt, Homo sapiens
ggucaggcggcggggugggcugg

SEQ ID NO: 9133 - RNA, 23 nt, Homo sapiens
gucaggcggcggggugggcuggu

SEQ ID NO: 9134 - RNA, 23 nt, Homo sapiens
ucaggcggcggggugggcuggug

SEQ ID NO: 9135 - RNA, 23 nt, Homo sapiens
caggcggcggggugggcuggugg

SEQ ID NO: 9136 - RNA, 23 nt, Homo sapiens
aggcggcggggugggcuggugga

SEQ ID NO: 9137 - RNA, 23 nt, Homo sapiens
ggcggcggggugggcugguggag

SEQ ID NO: 9138 - RNA, 23 nt, Homo sapiens
gcggcggggugggcugguggaga

SEQ ID NO: 9139 - RNA, 23 nt, Homo sapiens
cggcggggugggcugguggagag

SEQ ID NO: 9140 - RNA, 23 nt, Homo sapiens
ggcggggugggcugguggagagg

SEQ ID NO: 9141 - RNA, 23 nt, Homo sapiens
gcggggugggcugguggagaggc

SEQ ID NO: 9142 - RNA, 23 nt, Homo sapiens
cggggugggcugguggagaggca

SEQ ID NO: 9143 - RNA, 23 nt, Homo sapiens
ggggugggcugguggagaggcag

SEQ ID NO: 9144 - RNA, 23 nt, Homo sapiens
gggugggcugguggagaggcagg

SEQ ID NO: 9145 - RNA, 23 nt, Homo sapiens
ggugggcugguggagaggcagga

SEQ ID NO: 9146 - RNA, 23 nt, Homo sapiens
gugggcugguggagaggcaggag

SEQ ID NO: 9147 - RNA, 23 nt, Homo sapiens
ugggcugguggagaggcaggaga

SEQ ID NO: 9148 - RNA, 23 nt, Homo sapiens
gggcugguggagaggcaggagag

SEQ ID NO: 9149 - RNA, 23 nt, Homo sapiens
ggcugguggagaggcaggagagc

SEQ ID NO: 9150 - RNA, 23 nt, Homo sapiens
gcugguggagaggcaggagagcu

SEQ ID NO: 9151 - RNA, 23 nt, Homo sapiens
cugguggagaggcaggagagcuc

SEQ ID NO: 9152 - RNA, 23 nt, Homo sapiens
ugguggagaggcaggagagcucu

SEQ ID NO: 9153 - RNA, 23 nt, Homo sapiens
gguggagaggcaggagagcucug

SEQ ID NO: 9154 - RNA, 23 nt, Homo sapiens
guggagaggcaggagagcucugc

SEQ ID NO: 9155 - RNA, 23 nt, Homo sapiens
uggagaggcaggagagcucugcc

SEQ ID NO: 9156 - RNA, 23 nt, Homo sapiens
ggagaggcaggagagcucugccc

SEQ ID NO: 9157 - RNA, 23 nt, Homo sapiens
gagaggcaggagagcucugcccg

SEQ ID NO: 9158 - RNA, 23 nt, Homo sapiens
agaggcaggagagcucugcccgg

SEQ ID NO: 9159 - RNA, 23 nt, Homo sapiens
gaggcaggagagcucugcccggg

SEQ ID NO: 9160 - RNA, 23 nt, Homo sapiens
aggcaggagagcucugcccgggc

SEQ ID NO: 9161 - RNA, 23 nt, Homo sapiens
ggcaggagagcucugcccgggcu

SEQ ID NO: 9162 - RNA, 23 nt, Homo sapiens
gcaggagagcucugcccgggcug

SEQ ID NO: 9163 - RNA, 23 nt, Homo sapiens
caggagagcucugcccgggcugc

SEQ ID NO: 9164 - RNA, 23 nt, Homo sapiens
aggagagcucugcccgggcugcu

SEQ ID NO: 9165 - RNA, 23 nt, Homo sapiens
ggagagcucugcccgggcugcuc

SEQ ID NO: 9166 - RNA, 23 nt, Homo sapiens
gagagcucugcccgggcugcucc

SEQ ID NO: 9167 - RNA, 23 nt, Homo sapiens
agagcucugcccgggcugcuccc

SEQ ID NO: 9168 - RNA, 23 nt, Homo sapiens
gagcucugcccgggcugcuccca

SEQ ID NO: 9169 - RNA, 23 nt, Homo sapiens
agcucugcccgggcugcucccac

SEQ ID NO: 9170 - RNA, 23 nt, Homo sapiens
gcucugcccgggcugcucccaca

SEQ ID NO: 9171 - RNA, 23 nt, Homo sapiens
cucugcccgggcugcucccacag

SEQ ID NO: 9172 - RNA, 23 nt, Homo sapiens
ucugcccgggcugcucccacagc

SEQ ID NO: 9173 - RNA, 23 nt, Homo sapiens
cugcccgggcugcucccacagcc

SEQ ID NO: 9174 - RNA, 23 nt, Homo sapiens
ugcccgggcugcucccacagccc

SEQ ID NO: 9175 - RNA, 23 nt, Homo sapiens
gcccgggcugcucccacagccca

SEQ ID NO: 9176 - RNA, 23 nt, Homo sapiens
cccgggcugcucccacagcccag

SEQ ID NO: 9177 - RNA, 23 nt, Homo sapiens
ccgggcugcucccacagcccagg

SEQ ID NO: 9178 - RNA, 23 nt, Homo sapiens
cgggcugcucccacagcccaggc

SEQ ID NO: 9179 - RNA, 23 nt, Homo sapiens
gggcugcucccacagcccaggcg

SEQ ID NO: 9180 - RNA, 23 nt, Homo sapiens
ggcugcucccacagcccaggcgg

SEQ ID NO: 9181 - RNA, 23 nt, Homo sapiens
gcugcucccacagcccaggcggc

SEQ ID NO: 9182 - RNA, 23 nt, Homo sapiens
cugcucccacagcccaggcggcu

SEQ ID NO: 9183 - RNA, 23 nt, Homo sapiens
ugcucccacagcccaggcggcug

SEQ ID NO: 9184 - RNA, 23 nt, Homo sapiens
gcucccacagcccaggcggcugc

SEQ ID NO: 9185 - RNA, 23 nt, Homo sapiens
cucccacagcccaggcggcugcc

SEQ ID NO: 9186 - RNA, 23 nt, Homo sapiens
ucccacagcccaggcggcugccc

SEQ ID NO: 9187 - RNA, 23 nt, Homo sapiens
cccacagcccaggcggcugcccg

SEQ ID NO: 9188 - RNA, 23 nt, Homo sapiens
ccacagcccaggcggcugcccgc

SEQ ID NO: 9189 - RNA, 23 nt, Homo sapiens
cacagcccaggcggcugcccgca

SEQ ID NO: 9190 - RNA, 23 nt, Homo sapiens
acagcccaggcggcugcccgcaa

SEQ ID NO: 9191 - RNA, 23 nt, Homo sapiens
cagcccaggcggcugcccgcaaa

SEQ ID NO: 9192 - RNA, 23 nt, Homo sapiens
agcccaggcggcugcccgcaaac

SEQ ID NO: 9193 - RNA, 23 nt, Homo sapiens
gcccaggcggcugcccgcaaacc

SEQ ID NO: 9194 - RNA, 23 nt, Homo sapiens
cccaggcggcugcccgcaaaccc

SEQ ID NO: 9195 - RNA, 23 nt, Homo sapiens
ccaggcggcugcccgcaaacccg

SEQ ID NO: 9196 - RNA, 23 nt, Homo sapiens
caggcggcugcccgcaaacccgc

SEQ ID NO: 9197 - RNA, 23 nt, Homo sapiens
aggcggcugcccgcaaacccgcg

SEQ ID NO: 9198 - RNA, 23 nt, Homo sapiens
ggcggcugcccgcaaacccgcgc

SEQ ID NO: 9199 - RNA, 23 nt, Homo sapiens
gcggcugcccgcaaacccgcgcg

SEQ ID NO: 9200 - RNA, 23 nt, Homo sapiens
cggcugcccgcaaacccgcgcgu

SEQ ID NO: 9201 - RNA, 23 nt, Homo sapiens
ggcugcccgcaaacccgcgcgug

SEQ ID NO: 9202 - RNA, 23 nt, Homo sapiens
gcugcccgcaaacccgcgcgugc

SEQ ID NO: 9203 - RNA, 23 nt, Homo sapiens
cugcccgcaaacccgcgcgugcg

SEQ ID NO: 9204 - RNA, 23 nt, Homo sapiens
ugcccgcaaacccgcgcgugcgc

SEQ ID NO: 9205 - RNA, 23 nt, Homo sapiens
gcccgcaaacccgcgcgugcgca

SEQ ID NO: 9206 - RNA, 23 nt, Homo sapiens
cccgcaaacccgcgcgugcgcag

SEQ ID NO: 9207 - RNA, 23 nt, Homo sapiens
ccgcaaacccgcgcgugcgcagu

SEQ ID NO: 9208 - RNA, 23 nt, Homo sapiens
cgcaaacccgcgcgugcgcagua

SEQ ID NO: 9209 - RNA, 23 nt, Homo sapiens
gcaaacccgcgcgugcgcaguag

SEQ ID NO: 9210 - RNA, 23 nt, Homo sapiens
caaacccgcgcgugcgcaguagg

SEQ ID NO: 9211 - RNA, 23 nt, Homo sapiens
aaacccgcgcgugcgcaguaggc

SEQ ID NO: 9212 - RNA, 23 nt, Homo sapiens
aacccgcgcgugcgcaguaggcg

SEQ ID NO: 9213 - RNA, 23 nt, Homo sapiens
acccgcgcgugcgcaguaggcgg

SEQ ID NO: 9214 - RNA, 23 nt, Homo sapiens
cccgcgcgugcgcaguaggcggc

SEQ ID NO: 9215 - RNA, 23 nt, Homo sapiens
ccgcgcgugcgcaguaggcggcc

SEQ ID NO: 9216 - RNA, 23 nt, Homo sapiens
cgcgcgugcgcaguaggcggccc

SEQ ID NO: 9217 - RNA, 23 nt, Homo sapiens
gcgcgugcgcaguaggcggccca

SEQ ID NO: 9218 - RNA, 23 nt, Homo sapiens
cgcgugcgcaguaggcggcccac

SEQ ID NO: 9219 - RNA, 23 nt, Homo sapiens
gcgugcgcaguaggcggcccacc

SEQ ID NO: 9220 - RNA, 23 nt, Homo sapiens
cgugcgcaguaggcggcccaccu

SEQ ID NO: 9221 - RNA, 23 nt, Homo sapiens
gugcgcaguaggcggcccaccug

SEQ ID NO: 9222 - RNA, 23 nt, Homo sapiens
ugcgcaguaggcggcccaccugc

SEQ ID NO: 9223 - RNA, 23 nt, Homo sapiens
gcgcaguaggcggcccaccugcu

SEQ ID NO: 9224 - RNA, 23 nt, Homo sapiens
cgcaguaggcggcccaccugcug

SEQ ID NO: 9225 - RNA, 23 nt, Homo sapiens
gcaguaggcggcccaccugcugg

SEQ ID NO: 9226 - RNA, 23 nt, Homo sapiens
caguaggcggcccaccugcuggu

SEQ ID NO: 9227 - RNA, 23 nt, Homo sapiens
aguaggcggcccaccugcuggua

SEQ ID NO: 9228 - RNA, 23 nt, Homo sapiens
guaggcggcccaccugcugguac

SEQ ID NO: 9229 - RNA, 23 nt, Homo sapiens
uaggcggcccaccugcugguacc

SEQ ID NO: 9230 - RNA, 23 nt, Homo sapiens
aggcggcccaccugcugguaccu

SEQ ID NO: 9231 - RNA, 23 nt, Homo sapiens
ggcggcccaccugcugguaccug

SEQ ID NO: 9232 - RNA, 23 nt, Homo sapiens
gcggcccaccugcugguaccugg

SEQ ID NO: 9233 - RNA, 23 nt, Homo sapiens
cggcccaccugcugguaccuggg

SEQ ID NO: 9234 - RNA, 23 nt, Homo sapiens
ggcccaccugcugguaccugggc

SEQ ID NO: 9235 - RNA, 23 nt, Homo sapiens
gcccaccugcugguaccugggcc

SEQ ID NO: 9236 - RNA, 23 nt, Homo sapiens
cccaccugcugguaccugggccg

SEQ ID NO: 9237 - RNA, 23 nt, Homo sapiens
ccaccugcugguaccugggccgg

SEQ ID NO: 9238 - RNA, 23 nt, Homo sapiens
caccugcugguaccugggccggc

SEQ ID NO: 9239 - RNA, 23 nt, Homo sapiens
accugcugguaccugggccggcu

SEQ ID NO: 9240 - RNA, 23 nt, Homo sapiens
ccugcugguaccugggccggcuc

SEQ ID NO: 9241 - RNA, 23 nt, Homo sapiens
cugcugguaccugggccggcucu

SEQ ID NO: 9242 - RNA, 23 nt, Homo sapiens
ugcugguaccugggccggcucug

SEQ ID NO: 9243 - RNA, 23 nt, Homo sapiens
gcugguaccugggccggcucugg

SEQ ID NO: 9244 - RNA, 23 nt, Homo sapiens
cugguaccugggccggcucuggg

SEQ ID NO: 9245 - RNA, 23 nt, Homo sapiens
ugguaccugggccggcucuggga

SEQ ID NO: 9246 - RNA, 23 nt, Homo sapiens
gguaccugggccggcucugggau

SEQ ID NO: 9247 - RNA, 23 nt, Homo sapiens
guaccugggccggcucugggauc

SEQ ID NO: 9248 - RNA, 23 nt, Homo sapiens
uaccugggccggcucugggaucc

SEQ ID NO: 9249 - RNA, 23 nt, Homo sapiens
accugggccggcucugggauccc

SEQ ID NO: 9250 - RNA, 23 nt, Homo sapiens
ccugggccggcucugggaucccc

SEQ ID NO: 9251 - RNA, 23 nt, Homo sapiens
cugggccggcucugggauccccg

SEQ ID NO: 9252 - RNA, 23 nt, Homo sapiens
ugggccggcucugggauccccgg

SEQ ID NO: 9253 - RNA, 23 nt, Homo sapiens
gggccggcucugggauccccggg

SEQ ID NO: 9254 - RNA, 23 nt, Homo sapiens
ggccggcucugggauccccggga

SEQ ID NO: 9255 - RNA, 23 nt, Homo sapiens
gccggcucugggauccccgggau

SEQ ID NO: 9256 - RNA, 23 nt, Homo sapiens
ccggcucugggauccccgggaug

SEQ ID NO: 9257 - RNA, 23 nt, Homo sapiens
cggcucugggauccccgggaugc

SEQ ID NO: 9258 - RNA, 23 nt, Homo sapiens
ggcucugggauccccgggaugcc

SEQ ID NO: 9259 - RNA, 23 nt, Homo sapiens
gcucugggauccccgggaugccc

SEQ ID NO: 9260 - RNA, 23 nt, Homo sapiens
cucugggauccccgggaugccca

SEQ ID NO: 9261 - RNA, 23 nt, Homo sapiens
ucugggauccccgggaugcccag

SEQ ID NO: 9262 - RNA, 23 nt, Homo sapiens
cugggauccccgggaugcccagg

SEQ ID NO: 9263 - RNA, 23 nt, Homo sapiens
ugggauccccgggaugcccagga

SEQ ID NO: 9264 - RNA, 23 nt, Homo sapiens
gggauccccgggaugcccaggaa

SEQ ID NO: 9265 - RNA, 23 nt, Homo sapiens
ggauccccgggaugcccaggaaa

SEQ ID NO: 9266 - RNA, 23 nt, Homo sapiens
gauccccgggaugcccaggaaag

SEQ ID NO: 9267 - RNA, 23 nt, Homo sapiens
auccccgggaugcccaggaaaga

SEQ ID NO: 9268 - RNA, 23 nt, Homo sapiens
uccccgggaugcccaggaaagaa

SEQ ID NO: 9269 - RNA, 23 nt, Homo sapiens
ccccgggaugcccaggaaagaau

SEQ ID NO: 9270 - RNA, 23 nt, Homo sapiens
cccgggaugcccaggaaagaaug

SEQ ID NO: 9271 - RNA, 23 nt, Homo sapiens
ccgggaugcccaggaaagaaugg

SEQ ID NO: 9272 - RNA, 23 nt, Homo sapiens
cgggaugcccaggaaagaauggc

SEQ ID NO: 9273 - RNA, 23 nt, Homo sapiens
gggaugcccaggaaagaauggca

SEQ ID NO: 9274 - RNA, 23 nt, Homo sapiens
ggaugcccaggaaagaauggcag

SEQ ID NO: 9275 - RNA, 23 nt, Homo sapiens
gaugcccaggaaagaauggcagu

SEQ ID NO: 9276 - RNA, 23 nt, Homo sapiens
augcccaggaaagaauggcaguu

SEQ ID NO: 9277 - RNA, 23 nt, Homo sapiens
ugcccaggaaagaauggcaguuc

SEQ ID NO: 9278 - RNA, 23 nt, Homo sapiens
gcccaggaaagaauggcaguucu

SEQ ID NO: 9279 - RNA, 23 nt, Homo sapiens
cccaggaaagaauggcaguucuc

SEQ ID NO: 9280 - RNA, 23 nt, Homo sapiens
ccaggaaagaauggcaguucucc

SEQ ID NO: 9281 - RNA, 23 nt, Homo sapiens
caggaaagaauggcaguucuccg

SEQ ID NO: 9282 - RNA, 23 nt, Homo sapiens
aggaaagaauggcaguucuccgc

SEQ ID NO: 9283 - RNA, 23 nt, Homo sapiens
ggaaagaauggcaguucuccgcg

SEQ ID NO: 9284 - RNA, 23 nt, Homo sapiens
gaaagaauggcaguucuccgcgg

SEQ ID NO: 9285 - RNA, 23 nt, Homo sapiens
aaagaauggcaguucuccgcggu

SEQ ID NO: 9286 - RNA, 23 nt, Homo sapiens
aagaauggcaguucuccgcggug

SEQ ID NO: 9287 - RNA, 23 nt, Homo sapiens
agaauggcaguucuccgcggugu

SEQ ID NO: 9288 - RNA, 23 nt, Homo sapiens
gaauggcaguucuccgcggugug

SEQ ID NO: 9289 - RNA, 23 nt, Homo sapiens
aauggcaguucuccgcggugugg

SEQ ID NO: 9290 - RNA, 23 nt, Homo sapiens
auggcaguucuccgcggugugga

SEQ ID NO: 9291 - RNA, 23 nt, Homo sapiens
uggcaguucuccgcgguguggag

SEQ ID NO: 9292 - RNA, 23 nt, Homo sapiens
ggcaguucuccgcgguguggagu

SEQ ID NO: 9293 - RNA, 23 nt, Homo sapiens
gcaguucuccgcgguguggaguc

SEQ ID NO: 9294 - RNA, 23 nt, Homo sapiens
caguucuccgcgguguggagucu

SEQ ID NO: 9295 - RNA, 23 nt, Homo sapiens
aguucuccgcgguguggagucuc

SEQ ID NO: 9296 - RNA, 23 nt, Homo sapiens
guucuccgcgguguggagucucu

SEQ ID NO: 9297 - RNA, 23 nt, Homo sapiens
uucuccgcgguguggagucucuc

SEQ ID NO: 9298 - RNA, 23 nt, Homo sapiens
ucuccgcgguguggagucucuca

SEQ ID NO: 9299 - RNA, 23 nt, Homo sapiens
cuccgcgguguggagucucucac

SEQ ID NO: 9300 - RNA, 23 nt, Homo sapiens
uccgcgguguggagucucucacc

SEQ ID NO: 9301 - RNA, 23 nt, Homo sapiens
ccgcgguguggagucucucaccg

SEQ ID NO: 9302 - RNA, 23 nt, Homo sapiens
cgcgguguggagucucucaccgg

SEQ ID NO: 9303 - RNA, 23 nt, Homo sapiens
gcgguguggagucucucaccggg

SEQ ID NO: 9304 - RNA, 23 nt, Homo sapiens
cgguguggagucucucaccgggc

SEQ ID NO: 9305 - RNA, 23 nt, Homo sapiens
gguguggagucucucaccgggcc

SEQ ID NO: 9306 - RNA, 23 nt, Homo sapiens
guguggagucucucaccgggccu

SEQ ID NO: 9307 - RNA, 23 nt, Homo sapiens
uguggagucucucaccgggccua

SEQ ID NO: 9308 - RNA, 23 nt, Homo sapiens
guggagucucucaccgggccuag

SEQ ID NO: 9309 - RNA, 23 nt, Homo sapiens
uggagucucucaccgggccuaga

SEQ ID NO: 9310 - RNA, 23 nt, Homo sapiens
ggagucucucaccgggccuagac

SEQ ID NO: 9311 - RNA, 23 nt, Homo sapiens
gagucucucaccgggccuagacc

SEQ ID NO: 9312 - RNA, 23 nt, Homo sapiens
agucucucaccgggccuagaccu

SEQ ID NO: 9313 - RNA, 23 nt, Homo sapiens
gucucucaccgggccuagaccua

SEQ ID NO: 9314 - RNA, 23 nt, Homo sapiens
ucucucaccgggccuagaccuag

SEQ ID NO: 9315 - RNA, 23 nt, Homo sapiens
cucucaccgggccuagaccuaga

SEQ ID NO: 9316 - RNA, 23 nt, Homo sapiens
ucucaccgggccuagaccuagaa

SEQ ID NO: 9317 - RNA, 23 nt, Homo sapiens
cucaccgggccuagaccuagaag

SEQ ID NO: 9318 - RNA, 23 nt, Homo sapiens
ucaccgggccuagaccuagaagg

SEQ ID NO: 9319 - RNA, 23 nt, Homo sapiens
caccgggccuagaccuagaaggc

SEQ ID NO: 9320 - RNA, 23 nt, Homo sapiens
accgggccuagaccuagaaggca

SEQ ID NO: 9321 - RNA, 23 nt, Homo sapiens
ccgggccuagaccuagaaggcag

SEQ ID NO: 9322 - RNA, 23 nt, Homo sapiens
cgggccuagaccuagaaggcagg

SEQ ID NO: 9323 - RNA, 23 nt, Homo sapiens
gggccuagaccuagaaggcagga

SEQ ID NO: 9324 - RNA, 23 nt, Homo sapiens
ggccuagaccuagaaggcaggaa

SEQ ID NO: 9325 - RNA, 23 nt, Homo sapiens
gccuagaccuagaaggcaggaau

SEQ ID NO: 9326 - RNA, 23 nt, Homo sapiens
ccuagaccuagaaggcaggaauc

SEQ ID NO: 9327 - RNA, 23 nt, Homo sapiens
cuagaccuagaaggcaggaaucc

SEQ ID NO: 9328 - RNA, 23 nt, Homo sapiens
uagaccuagaaggcaggaauccc

SEQ ID NO: 9329 - RNA, 23 nt, Homo sapiens
agaccuagaaggcaggaauccca

SEQ ID NO: 9330 - RNA, 23 nt, Homo sapiens
gaccuagaaggcaggaaucccag

SEQ ID NO: 9331 - RNA, 23 nt, Homo sapiens
accuagaaggcaggaaucccagg

SEQ ID NO: 9332 - RNA, 23 nt, Homo sapiens
ccuagaaggcaggaaucccaggc

SEQ ID NO: 9333 - RNA, 23 nt, Homo sapiens
cuagaaggcaggaaucccaggcc

SEQ ID NO: 9334 - RNA, 23 nt, Homo sapiens
uagaaggcaggaaucccaggccg

SEQ ID NO: 9335 - RNA, 23 nt, Homo sapiens
agaaggcaggaaucccaggccgg

SEQ ID NO: 9336 - RNA, 23 nt, Homo sapiens
gaaggcaggaaucccaggccggu

SEQ ID NO: 9337 - RNA, 23 nt, Homo sapiens
aaggcaggaaucccaggccgguc

SEQ ID NO: 9338 - RNA, 23 nt, Homo sapiens
aggcaggaaucccaggccgguca

SEQ ID NO: 9339 - RNA, 23 nt, Homo sapiens
ggcaggaaucccaggccggucag

SEQ ID NO: 9340 - RNA, 23 nt, Homo sapiens
gcaggaaucccaggccggucagc

SEQ ID NO: 9341 - RNA, 23 nt, Homo sapiens
caggaaucccaggccggucagcc

SEQ ID NO: 9342 - RNA, 23 nt, Homo sapiens
aggaaucccaggccggucagccc

SEQ ID NO: 9343 - RNA, 23 nt, Homo sapiens
ggaaucccaggccggucagcccg

SEQ ID NO: 9344 - RNA, 23 nt, Homo sapiens
gaaucccaggccggucagcccgg

SEQ ID NO: 9345 - RNA, 23 nt, Homo sapiens
aaucccaggccggucagcccggu

SEQ ID NO: 9346 - RNA, 23 nt, Homo sapiens
aucccaggccggucagcccggug

SEQ ID NO: 9347 - RNA, 23 nt, Homo sapiens
ucccaggccggucagcccggugg

SEQ ID NO: 9348 - RNA, 23 nt, Homo sapiens
cccaggccggucagcccggugga

SEQ ID NO: 9349 - RNA, 23 nt, Homo sapiens
ccaggccggucagcccgguggag

SEQ ID NO: 9350 - RNA, 23 nt, Homo sapiens
caggccggucagcccgguggagg

SEQ ID NO: 9351 - RNA, 23 nt, Homo sapiens
aggccggucagcccgguggaggg

SEQ ID NO: 9352 - RNA, 23 nt, Homo sapiens
ggccggucagcccgguggagggg

SEQ ID NO: 9353 - RNA, 23 nt, Homo sapiens
gccggucagcccgguggaggggg

SEQ ID NO: 9354 - RNA, 23 nt, Homo sapiens
ccggucagcccgguggagggggc

SEQ ID NO: 9355 - RNA, 23 nt, Homo sapiens
cggucagcccgguggagggggcg

SEQ ID NO: 9356 - RNA, 23 nt, Homo sapiens
ggucagcccgguggagggggcgg

SEQ ID NO: 9357 - RNA, 23 nt, Homo sapiens
gucagcccgguggagggggcggg

SEQ ID NO: 9358 - RNA, 23 nt, Homo sapiens
ucagcccgguggagggggcgggg

SEQ ID NO: 9359 - RNA, 23 nt, Homo sapiens
cagcccgguggagggggcggggc

SEQ ID NO: 9360 - RNA, 23 nt, Homo sapiens
agcccgguggagggggcggggcg

SEQ ID NO: 9361 - RNA, 23 nt, Homo sapiens
gcccgguggagggggcggggcgg

SEQ ID NO: 9362 - RNA, 23 nt, Homo sapiens
cccgguggagggggcggggcgga

SEQ ID NO: 9363 - RNA, 23 nt, Homo sapiens
ccgguggagggggcggggcggag

SEQ ID NO: 9364 - RNA, 23 nt, Homo sapiens
cgguggagggggcggggcggaga

SEQ ID NO: 9365 - RNA, 23 nt, Homo sapiens
gguggagggggcggggcggagac

SEQ ID NO: 9366 - RNA, 23 nt, Homo sapiens
guggagggggcggggcggagaca

SEQ ID NO: 9367 - RNA, 23 nt, Homo sapiens
uggagggggcggggcggagacac

SEQ ID NO: 9368 - RNA, 23 nt, Homo sapiens
ggagggggcggggcggagacacg

SEQ ID NO: 9369 - RNA, 23 nt, Homo sapiens
gagggggcggggcggagacacgc

SEQ ID NO: 9370 - RNA, 23 nt, Homo sapiens
agggggcggggcggagacacgcc

SEQ ID NO: 9371 - RNA, 23 nt, Homo sapiens
gggggcggggcggagacacgccc

SEQ ID NO: 9372 - RNA, 23 nt, Homo sapiens
ggggcggggcggagacacgcccc

SEQ ID NO: 9373 - RNA, 23 nt, Homo sapiens
gggcggggcggagacacgccccu

SEQ ID NO: 9374 - RNA, 23 nt, Homo sapiens
ggcggggcggagacacgccccuc

SEQ ID NO: 9375 - RNA, 23 nt, Homo sapiens
gcggggcggagacacgccccucc

SEQ ID NO: 9376 - RNA, 23 nt, Homo sapiens
cggggcggagacacgccccuccg

SEQ ID NO: 9377 - RNA, 23 nt, Homo sapiens
ggggcggagacacgccccuccgu

SEQ ID NO: 9378 - RNA, 23 nt, Homo sapiens
gggcggagacacgccccuccgua

SEQ ID NO: 9379 - RNA, 23 nt, Homo sapiens
ggcggagacacgccccuccguag

SEQ ID NO: 9380 - RNA, 23 nt, Homo sapiens
gcggagacacgccccuccguagc

SEQ ID NO: 9381 - RNA, 23 nt, Homo sapiens
cggagacacgccccuccguagcc

SEQ ID NO: 9382 - RNA, 23 nt, Homo sapiens
ggagacacgccccuccguagcca

SEQ ID NO: 9383 - RNA, 23 nt, Homo sapiens
gagacacgccccuccguagccag

SEQ ID NO: 9384 - RNA, 23 nt, Homo sapiens
agacacgccccuccguagccagc

SEQ ID NO: 9385 - RNA, 23 nt, Homo sapiens
gacacgccccuccguagccagcc

SEQ ID NO: 9386 - RNA, 23 nt, Homo sapiens
acacgccccuccguagccagcca

SEQ ID NO: 9387 - RNA, 23 nt, Homo sapiens
cacgccccuccguagccagccag

SEQ ID NO: 9388 - RNA, 23 nt, Homo sapiens
acgccccuccguagccagccagg

SEQ ID NO: 9389 - RNA, 23 nt, Homo sapiens
cgccccuccguagccagccaggu

SEQ ID NO: 9390 - RNA, 23 nt, Homo sapiens
gccccuccguagccagccaggug

SEQ ID NO: 9391 - RNA, 23 nt, Homo sapiens
ccccuccguagccagccaggugu

SEQ ID NO: 9392 - RNA, 23 nt, Homo sapiens
cccuccguagccagccagguguu

SEQ ID NO: 9393 - RNA, 23 nt, Homo sapiens
ccuccguagccagccagguguuc

SEQ ID NO: 9394 - RNA, 23 nt, Homo sapiens
cuccguagccagccagguguucc

SEQ ID NO: 9395 - RNA, 23 nt, Homo sapiens
uccguagccagccagguguuccc

SEQ ID NO: 9396 - RNA, 23 nt, Homo sapiens
ccguagccagccagguguucccc

SEQ ID NO: 9397 - RNA, 23 nt, Homo sapiens
cguagccagccagguguuccccg

SEQ ID NO: 9398 - RNA, 23 nt, Homo sapiens
guagccagccagguguuccccgc

SEQ ID NO: 9399 - RNA, 23 nt, Homo sapiens
uagccagccagguguuccccgcg

SEQ ID NO: 9400 - RNA, 23 nt, Homo sapiens
agccagccagguguuccccgcga

SEQ ID NO: 9401 - RNA, 23 nt, Homo sapiens
gccagccagguguuccccgcgaa

SEQ ID NO: 9402 - RNA, 23 nt, Homo sapiens
ccagccagguguuccccgcgaaa

SEQ ID NO: 9403 - RNA, 23 nt, Homo sapiens
cagccagguguuccccgcgaaag

SEQ ID NO: 9404 - RNA, 23 nt, Homo sapiens
agccagguguuccccgcgaaaga

SEQ ID NO: 9405 - RNA, 23 nt, Homo sapiens
gccagguguuccccgcgaaagag

SEQ ID NO: 9406 - RNA, 23 nt, Homo sapiens
ccagguguuccccgcgaaagaga

SEQ ID NO: 9407 - RNA, 23 nt, Homo sapiens
cagguguuccccgcgaaagagag

SEQ ID NO: 9408 - RNA, 23 nt, Homo sapiens
agguguuccccgcgaaagagagg

SEQ ID NO: 9409 - RNA, 23 nt, Homo sapiens
gguguuccccgcgaaagagaggc

SEQ ID NO: 9410 - RNA, 23 nt, Homo sapiens
guguuccccgcgaaagagaggcc

SEQ ID NO: 9411 - RNA, 23 nt, Homo sapiens
uguuccccgcgaaagagaggcca

SEQ ID NO: 9412 - RNA, 23 nt, Homo sapiens
guuccccgcgaaagagaggccac

SEQ ID NO: 9413 - RNA, 23 nt, Homo sapiens
uuccccgcgaaagagaggccacg

SEQ ID NO: 9414 - RNA, 23 nt, Homo sapiens
uccccgcgaaagagaggccacgg

SEQ ID NO: 9415 - RNA, 23 nt, Homo sapiens
ccccgcgaaagagaggccacggc

SEQ ID NO: 9416 - RNA, 23 nt, Homo sapiens
cccgcgaaagagaggccacggcc

SEQ ID NO: 9417 - RNA, 23 nt, Homo sapiens
ccgcgaaagagaggccacggccc

SEQ ID NO: 9418 - RNA, 23 nt, Homo sapiens
cgcgaaagagaggccacggcccu

SEQ ID NO: 9419 - RNA, 23 nt, Homo sapiens
gcgaaagagaggccacggcccug

SEQ ID NO: 9420 - RNA, 23 nt, Homo sapiens
cgaaagagaggccacggcccugc

SEQ ID NO: 9421 - RNA, 23 nt, Homo sapiens
gaaagagaggccacggcccugcc

SEQ ID NO: 9422 - RNA, 23 nt, Homo sapiens
aaagagaggccacggcccugccc

SEQ ID NO: 9423 - RNA, 23 nt, Homo sapiens
aagagaggccacggcccugcccc

SEQ ID NO: 9424 - RNA, 23 nt, Homo sapiens
agagaggccacggcccugccccg

SEQ ID NO: 9425 - RNA, 23 nt, Homo sapiens
gagaggccacggcccugccccga

SEQ ID NO: 9426 - RNA, 23 nt, Homo sapiens
agaggccacggcccugccccgaa

SEQ ID NO: 9427 - RNA, 23 nt, Homo sapiens
gaggccacggcccugccccgaac

SEQ ID NO: 9428 - RNA, 23 nt, Homo sapiens
aggccacggcccugccccgaacc

SEQ ID NO: 9429 - RNA, 23 nt, Homo sapiens
ggccacggcccugccccgaacca

SEQ ID NO: 9430 - RNA, 23 nt, Homo sapiens
gccacggcccugccccgaaccac

SEQ ID NO: 9431 - RNA, 23 nt, Homo sapiens
ccacggcccugccccgaaccacc

SEQ ID NO: 9432 - RNA, 23 nt, Homo sapiens
cacggcccugccccgaaccaccc

SEQ ID NO: 9433 - RNA, 23 nt, Homo sapiens
acggcccugccccgaaccacccg

SEQ ID NO: 9434 - RNA, 23 nt, Homo sapiens
cggcccugccccgaaccacccga

SEQ ID NO: 9435 - RNA, 23 nt, Homo sapiens
ggcccugccccgaaccacccgac

SEQ ID NO: 9436 - RNA, 23 nt, Homo sapiens
gcccugccccgaaccacccgacc

SEQ ID NO: 9437 - RNA, 23 nt, Homo sapiens
cccugccccgaaccacccgaccc

SEQ ID NO: 9438 - RNA, 23 nt, Homo sapiens
ccugccccgaaccacccgacccc

SEQ ID NO: 9439 - RNA, 23 nt, Homo sapiens
cugccccgaaccacccgaccccg

SEQ ID NO: 9440 - RNA, 23 nt, Homo sapiens
ugccccgaaccacccgaccccgu

SEQ ID NO: 9441 - RNA, 23 nt, Homo sapiens
gccccgaaccacccgaccccguc

SEQ ID NO: 9442 - RNA, 23 nt, Homo sapiens
ccccgaaccacccgaccccgucc

SEQ ID NO: 9443 - RNA, 23 nt, Homo sapiens
cccgaaccacccgaccccguccc

SEQ ID NO: 9444 - RNA, 23 nt, Homo sapiens
ccgaaccacccgaccccguccca

SEQ ID NO: 9445 - RNA, 23 nt, Homo sapiens
cgaaccacccgaccccgucccaa

SEQ ID NO: 9446 - RNA, 23 nt, Homo sapiens
gaaccacccgaccccgucccaac

SEQ ID NO: 9447 - RNA, 23 nt, Homo sapiens
aaccacccgaccccgucccaacc

SEQ ID NO: 9448 - RNA, 23 nt, Homo sapiens
accacccgaccccgucccaaccc

SEQ ID NO: 9449 - RNA, 23 nt, Homo sapiens
ccacccgaccccgucccaacccc

SEQ ID NO: 9450 - RNA, 23 nt, Homo sapiens
cacccgaccccgucccaaccccg

SEQ ID NO: 9451 - RNA, 23 nt, Homo sapiens
acccgaccccgucccaaccccgc

SEQ ID NO: 9452 - RNA, 23 nt, Homo sapiens
cccgaccccgucccaaccccgcg

SEQ ID NO: 9453 - RNA, 23 nt, Homo sapiens
ccgaccccgucccaaccccgcgu

SEQ ID NO: 9454 - RNA, 23 nt, Homo sapiens
cgaccccgucccaaccccgcguc

SEQ ID NO: 9455 - RNA, 23 nt, Homo sapiens
gaccccgucccaaccccgcgucc

SEQ ID NO: 9456 - RNA, 23 nt, Homo sapiens
accccgucccaaccccgcguccu

SEQ ID NO: 9457 - RNA, 23 nt, Homo sapiens
ccccgucccaaccccgcguccua

SEQ ID NO: 9458 - RNA, 23 nt, Homo sapiens
cccgucccaaccccgcguccuaa

SEQ ID NO: 9459 - RNA, 23 nt, Homo sapiens
ccgucccaaccccgcguccuaaa

SEQ ID NO: 9460 - RNA, 23 nt, Homo sapiens
cgucccaaccccgcguccuaaag

SEQ ID NO: 9461 - RNA, 23 nt, Homo sapiens
gucccaaccccgcguccuaaagc

SEQ ID NO: 9462 - RNA, 23 nt, Homo sapiens
ucccaaccccgcguccuaaagcu

SEQ ID NO: 9463 - RNA, 23 nt, Homo sapiens
cccaaccccgcguccuaaagcuc

SEQ ID NO: 9464 - RNA, 23 nt, Homo sapiens
ccaaccccgcguccuaaagcucc

SEQ ID NO: 9465 - RNA, 23 nt, Homo sapiens
caaccccgcguccuaaagcuccu

SEQ ID NO: 9466 - RNA, 23 nt, Homo sapiens
aaccccgcguccuaaagcuccuc

SEQ ID NO: 9467 - RNA, 23 nt, Homo sapiens
accccgcguccuaaagcuccucc

SEQ ID NO: 9468 - RNA, 23 nt, Homo sapiens
ccccgcguccuaaagcuccucca

SEQ ID NO: 9469 - RNA, 23 nt, Homo sapiens
cccgcguccuaaagcuccuccag

SEQ ID NO: 9470 - RNA, 23 nt, Homo sapiens
ccgcguccuaaagcuccuccagc

SEQ ID NO: 9471 - RNA, 23 nt, Homo sapiens
cgcguccuaaagcuccuccagca

SEQ ID NO: 9472 - RNA, 23 nt, Homo sapiens
gcguccuaaagcuccuccagcag

SEQ ID NO: 9473 - RNA, 23 nt, Homo sapiens
cguccuaaagcuccuccagcaga

SEQ ID NO: 9474 - RNA, 23 nt, Homo sapiens
guccuaaagcuccuccagcagag

SEQ ID NO: 9475 - RNA, 23 nt, Homo sapiens
uccuaaagcuccuccagcagagc

SEQ ID NO: 9476 - RNA, 23 nt, Homo sapiens
ccuaaagcuccuccagcagagcc

SEQ ID NO: 9477 - RNA, 23 nt, Homo sapiens
cuaaagcuccuccagcagagccc

SEQ ID NO: 9478 - RNA, 23 nt, Homo sapiens
uaaagcuccuccagcagagcccg

SEQ ID NO: 9479 - RNA, 23 nt, Homo sapiens
aaagcuccuccagcagagcccgg

SEQ ID NO: 9480 - RNA, 23 nt, Homo sapiens
aagcuccuccagcagagcccggu

SEQ ID NO: 9481 - RNA, 23 nt, Homo sapiens
agcuccuccagcagagcccggua

SEQ ID NO: 9482 - RNA, 23 nt, Homo sapiens
gcuccuccagcagagcccgguau

SEQ ID NO: 9483 - RNA, 23 nt, Homo sapiens
cuccuccagcagagcccgguauu

SEQ ID NO: 9484 - RNA, 23 nt, Homo sapiens
uccuccagcagagcccgguauuc

SEQ ID NO: 9485 - RNA, 23 nt, Homo sapiens
ccuccagcagagcccgguauucu

SEQ ID NO: 9486 - RNA, 23 nt, Homo sapiens
cuccagcagagcccgguauucuu

SEQ ID NO: 9487 - RNA, 23 nt, Homo sapiens
uccagcagagcccgguauucuuc

SEQ ID NO: 9488 - RNA, 23 nt, Homo sapiens
ccagcagagcccgguauucuucc

SEQ ID NO: 9489 - RNA, 23 nt, Homo sapiens
cagcagagcccgguauucuuccu

SEQ ID NO: 9490 - RNA, 23 nt, Homo sapiens
agcagagcccgguauucuuccuc

SEQ ID NO: 9491 - RNA, 23 nt, Homo sapiens
gcagagcccgguauucuuccucg

SEQ ID NO: 9492 - RNA, 23 nt, Homo sapiens
cagagcccgguauucuuccucgc

SEQ ID NO: 9493 - RNA, 23 nt, Homo sapiens
agagcccgguauucuuccucgcu

SEQ ID NO: 9494 - RNA, 23 nt, Homo sapiens
gagcccgguauucuuccucgcug

SEQ ID NO: 9495 - RNA, 23 nt, Homo sapiens
agcccgguauucuuccucgcuga

SEQ ID NO: 9496 - RNA, 23 nt, Homo sapiens
gcccgguauucuuccucgcugag

SEQ ID NO: 9497 - RNA, 23 nt, Homo sapiens
cccgguauucuuccucgcugagg

SEQ ID NO: 9498 - RNA, 23 nt, Homo sapiens
ccgguauucuuccucgcugaggg

SEQ ID NO: 9499 - RNA, 23 nt, Homo sapiens
cgguauucuuccucgcugagggg

SEQ ID NO: 9500 - RNA, 23 nt, Homo sapiens
gguauucuuccucgcugaggggu

SEQ ID NO: 9501 - RNA, 23 nt, Homo sapiens
guauucuuccucgcugaggggug

SEQ ID NO: 9502 - RNA, 23 nt, Homo sapiens
uauucuuccucgcugaggggugc

SEQ ID NO: 9503 - RNA, 23 nt, Homo sapiens
auucuuccucgcugaggggugcu

SEQ ID NO: 9504 - RNA, 23 nt, Homo sapiens
uucuuccucgcugaggggugcuu

SEQ ID NO: 9505 - RNA, 23 nt, Homo sapiens
ucuuccucgcugaggggugcuuc

SEQ ID NO: 9506 - RNA, 23 nt, Homo sapiens
cuuccucgcugaggggugcuucc

SEQ ID NO: 9507 - RNA, 23 nt, Homo sapiens
uuccucgcugaggggugcuucca

SEQ ID NO: 9508 - RNA, 23 nt, Homo sapiens
uccucgcugaggggugcuuccag

SEQ ID NO: 9509 - RNA, 23 nt, Homo sapiens
ccucgcugaggggugcuuccagc

SEQ ID NO: 9510 - RNA, 23 nt, Homo sapiens
cucgcugaggggugcuuccagcg

SEQ ID NO: 9511 - RNA, 23 nt, Homo sapiens
ucgcugaggggugcuuccagcga

SEQ ID NO: 9512 - RNA, 23 nt, Homo sapiens
cgcugaggggugcuuccagcgag

SEQ ID NO: 9513 - RNA, 23 nt, Homo sapiens
gcugaggggugcuuccagcgagg

SEQ ID NO: 9514 - RNA, 23 nt, Homo sapiens
cugaggggugcuuccagcgaggc

SEQ ID NO: 9515 - RNA, 23 nt, Homo sapiens
ugaggggugcuuccagcgaggcg

SEQ ID NO: 9516 - RNA, 23 nt, Homo sapiens
gaggggugcuuccagcgaggcgg

SEQ ID NO: 9517 - RNA, 23 nt, Homo sapiens
aggggugcuuccagcgaggcggc

SEQ ID NO: 9518 - RNA, 23 nt, Homo sapiens
ggggugcuuccagcgaggcggcc

SEQ ID NO: 9519 - RNA, 23 nt, Homo sapiens
gggugcuuccagcgaggcggccu

SEQ ID NO: 9520 - RNA, 23 nt, Homo sapiens
ggugcuuccagcgaggcggccuc

SEQ ID NO: 9521 - RNA, 23 nt, Homo sapiens
gugcuuccagcgaggcggccucu

SEQ ID NO: 9522 - RNA, 23 nt, Homo sapiens
ugcuuccagcgaggcggccucuu

SEQ ID NO: 9523 - RNA, 23 nt, Homo sapiens
gcuuccagcgaggcggccucuuc

SEQ ID NO: 9524 - RNA, 23 nt, Homo sapiens
cuuccagcgaggcggccucuucc

SEQ ID NO: 9525 - RNA, 23 nt, Homo sapiens
uuccagcgaggcggccucuuccg

SEQ ID NO: 9526 - RNA, 23 nt, Homo sapiens
uccagcgaggcggccucuuccga

SEQ ID NO: 9527 - RNA, 23 nt, Homo sapiens
ccagcgaggcggccucuuccgag

SEQ ID NO: 9528 - RNA, 23 nt, Homo sapiens
cagcgaggcggccucuuccgagg

SEQ ID NO: 9529 - RNA, 23 nt, Homo sapiens
agcgaggcggccucuuccgaggc

SEQ ID NO: 9530 - RNA, 23 nt, Homo sapiens
gcgaggcggccucuuccgaggcc

SEQ ID NO: 9531 - RNA, 23 nt, Homo sapiens
cgaggcggccucuuccgaggccu

SEQ ID NO: 9532 - RNA, 23 nt, Homo sapiens
gaggcggccucuuccgaggccuc

SEQ ID NO: 9533 - RNA, 23 nt, Homo sapiens
aggcggccucuuccgaggccucc

SEQ ID NO: 9534 - RNA, 23 nt, Homo sapiens
ggcggccucuuccgaggccucca

SEQ ID NO: 9535 - RNA, 23 nt, Homo sapiens
gcggccucuuccgaggccuccag

SEQ ID NO: 9536 - RNA, 23 nt, Homo sapiens
cggccucuuccgaggccuccagc

SEQ ID NO: 9537 - RNA, 23 nt, Homo sapiens
ggccucuuccgaggccuccagcu

SEQ ID NO: 9538 - RNA, 23 nt, Homo sapiens
gccucuuccgaggccuccagcuc

SEQ ID NO: 9539 - RNA, 23 nt, Homo sapiens
ccucuuccgaggccuccagcucc

SEQ ID NO: 9540 - RNA, 23 nt, Homo sapiens
cucuuccgaggccuccagcuccc

SEQ ID NO: 9541 - RNA, 23 nt, Homo sapiens
ucuuccgaggccuccagcucccc

SEQ ID NO: 9542 - RNA, 23 nt, Homo sapiens
cuuccgaggccuccagcuccccc

SEQ ID NO: 9543 - RNA, 23 nt, Homo sapiens
uuccgaggccuccagcucccccg

SEQ ID NO: 9544 - RNA, 23 nt, Homo sapiens
uccgaggccuccagcucccccgg

SEQ ID NO: 9545 - RNA, 23 nt, Homo sapiens
ccgaggccuccagcucccccggg

SEQ ID NO: 9546 - RNA, 23 nt, Homo sapiens
cgaggccuccagcucccccgggg

SEQ ID NO: 9547 - RNA, 23 nt, Homo sapiens
gaggccuccagcucccccggggc

SEQ ID NO: 9548 - RNA, 23 nt, Homo sapiens
aggccuccagcucccccggggcc

SEQ ID NO: 9549 - RNA, 23 nt, Homo sapiens
ggccuccagcucccccggggccu

SEQ ID NO: 9550 - RNA, 23 nt, Homo sapiens
gccuccagcucccccggggccuc

SEQ ID NO: 9551 - RNA, 23 nt, Homo sapiens
ccuccagcucccccggggccucc

SEQ ID NO: 9552 - RNA, 23 nt, Homo sapiens
cuccagcucccccggggccuccg

SEQ ID NO: 9553 - RNA, 23 nt, Homo sapiens
uccagcucccccggggccuccgu

SEQ ID NO: 9554 - RNA, 23 nt, Homo sapiens
ccagcucccccggggccuccguu

SEQ ID NO: 9555 - RNA, 23 nt, Homo sapiens
cagcucccccggggccuccguuu

SEQ ID NO: 9556 - RNA, 23 nt, Homo sapiens
agcucccccggggccuccguuuc

SEQ ID NO: 9557 - RNA, 23 nt, Homo sapiens
gcucccccggggccuccguuucu

SEQ ID NO: 9558 - RNA, 23 nt, Homo sapiens
cucccccggggccuccguuucua

SEQ ID NO: 9559 - RNA, 23 nt, Homo sapiens
ucccccggggccuccguuucuag

SEQ ID NO: 9560 - RNA, 23 nt, Homo sapiens
cccccggggccuccguuucuagg

SEQ ID NO: 9561 - RNA, 23 nt, Homo sapiens
ccccggggccuccguuucuagga

SEQ ID NO: 9562 - RNA, 23 nt, Homo sapiens
cccggggccuccguuucuaggag

SEQ ID NO: 9563 - RNA, 23 nt, Homo sapiens
ccggggccuccguuucuaggaga

SEQ ID NO: 9564 - RNA, 23 nt, Homo sapiens
cggggccuccguuucuaggagag

SEQ ID NO: 9565 - RNA, 23 nt, Homo sapiens
ggggccuccguuucuaggagagg

SEQ ID NO: 9566 - RNA, 23 nt, Homo sapiens
gggccuccguuucuaggagaggu

SEQ ID NO: 9567 - RNA, 23 nt, Homo sapiens
ggccuccguuucuaggagagguu

SEQ ID NO: 9568 - RNA, 23 nt, Homo sapiens
gccuccguuucuaggagagguug

SEQ ID NO: 9569 - RNA, 23 nt, Homo sapiens
ccuccguuucuaggagagguugc

SEQ ID NO: 9570 - RNA, 23 nt, Homo sapiens
cuccguuucuaggagagguugcg

SEQ ID NO: 9571 - RNA, 23 nt, Homo sapiens
uccguuucuaggagagguugcgc

SEQ ID NO: 9572 - RNA, 23 nt, Homo sapiens
ccguuucuaggagagguugcgcc

SEQ ID NO: 9573 - RNA, 23 nt, Homo sapiens
cguuucuaggagagguugcgccu

SEQ ID NO: 9574 - RNA, 23 nt, Homo sapiens
guuucuaggagagguugcgccug

SEQ ID NO: 9575 - RNA, 23 nt, Homo sapiens
uuucuaggagagguugcgccugc

SEQ ID NO: 9576 - RNA, 23 nt, Homo sapiens
uucuaggagagguugcgccugcu

SEQ ID NO: 9577 - RNA, 23 nt, Homo sapiens
ucuaggagagguugcgccugcug

SEQ ID NO: 9578 - RNA, 23 nt, Homo sapiens
cuaggagagguugcgccugcugc

SEQ ID NO: 9579 - RNA, 23 nt, Homo sapiens
uaggagagguugcgccugcugca

SEQ ID NO: 9580 - RNA, 23 nt, Homo sapiens
aggagagguugcgccugcugcag

SEQ ID NO: 9581 - RNA, 23 nt, Homo sapiens
ggagagguugcgccugcugcaga

SEQ ID NO: 9582 - RNA, 23 nt, Homo sapiens
gagagguugcgccugcugcagaa

SEQ ID NO: 9583 - RNA, 23 nt, Homo sapiens
agagguugcgccugcugcagaaa

SEQ ID NO: 9584 - RNA, 23 nt, Homo sapiens
gagguugcgccugcugcagaaac

SEQ ID NO: 9585 - RNA, 23 nt, Homo sapiens
agguugcgccugcugcagaaacu

SEQ ID NO: 9586 - RNA, 23 nt, Homo sapiens
gguugcgccugcugcagaaacuc

SEQ ID NO: 9587 - RNA, 23 nt, Homo sapiens
guugcgccugcugcagaaacucc

SEQ ID NO: 9588 - RNA, 23 nt, Homo sapiens
uugcgccugcugcagaaacuccg

SEQ ID NO: 9589 - RNA, 23 nt, Homo sapiens
ugcgccugcugcagaaacuccgg

SEQ ID NO: 9590 - RNA, 23 nt, Homo sapiens
gcgccugcugcagaaacuccggg

SEQ ID NO: 9591 - RNA, 23 nt, Homo sapiens
cgccugcugcagaaacuccgggc

SEQ ID NO: 9592 - RNA, 23 nt, Homo sapiens
gccugcugcagaaacuccgggcu

SEQ ID NO: 9593 - RNA, 23 nt, Homo sapiens
ccugcugcagaaacuccgggcuc

SEQ ID NO: 9594 - RNA, 23 nt, Homo sapiens
cugcugcagaaacuccgggcucg

SEQ ID NO: 9595 - RNA, 23 nt, Homo sapiens
ugcugcagaaacuccgggcucgc

SEQ ID NO: 9596 - RNA, 23 nt, Homo sapiens
gcugcagaaacuccgggcucgcc

SEQ ID NO: 9597 - RNA, 23 nt, Homo sapiens
cugcagaaacuccgggcucgcca

SEQ ID NO: 9598 - RNA, 23 nt, Homo sapiens
ugcagaaacuccgggcucgccag

SEQ ID NO: 9599 - RNA, 23 nt, Homo sapiens
gcagaaacuccgggcucgccagg

SEQ ID NO: 9600 - RNA, 23 nt, Homo sapiens
cagaaacuccgggcucgccagga

SEQ ID NO: 9601 - RNA, 23 nt, Homo sapiens
agaaacuccgggcucgccaggag

SEQ ID NO: 9602 - RNA, 23 nt, Homo sapiens
gaaacuccgggcucgccaggagc

SEQ ID NO: 9603 - RNA, 23 nt, Homo sapiens
aaacuccgggcucgccaggagcu

SEQ ID NO: 9604 - RNA, 23 nt, Homo sapiens
aacuccgggcucgccaggagcuc

SEQ ID NO: 9605 - RNA, 23 nt, Homo sapiens
acuccgggcucgccaggagcuca

SEQ ID NO: 9606 - RNA, 23 nt, Homo sapiens
cuccgggcucgccaggagcucau

SEQ ID NO: 9607 - RNA, 23 nt, Homo sapiens
uccgggcucgccaggagcucauc

SEQ ID NO: 9608 - RNA, 23 nt, Homo sapiens
ccgggcucgccaggagcucaucc

SEQ ID NO: 9609 - RNA, 23 nt, Homo sapiens
cgggcucgccaggagcucaucca

SEQ ID NO: 9610 - RNA, 23 nt, Homo sapiens
gggcucgccaggagcucauccag

SEQ ID NO: 9611 - RNA, 23 nt, Homo sapiens
ggcucgccaggagcucauccagc

SEQ ID NO: 9612 - RNA, 23 nt, Homo sapiens
gcucgccaggagcucauccagca

SEQ ID NO: 9613 - RNA, 23 nt, Homo sapiens
cucgccaggagcucauccagcag

SEQ ID NO: 9614 - RNA, 23 nt, Homo sapiens
ucgccaggagcucauccagcagc

SEQ ID NO: 9615 - RNA, 23 nt, Homo sapiens
cgccaggagcucauccagcagca

SEQ ID NO: 9616 - RNA, 23 nt, Homo sapiens
gccaggagcucauccagcagcag

SEQ ID NO: 9617 - RNA, 23 nt, Homo sapiens
ccaggagcucauccagcagcagg

SEQ ID NO: 9618 - RNA, 23 nt, Homo sapiens
caggagcucauccagcagcaggc

SEQ ID NO: 9619 - RNA, 23 nt, Homo sapiens
aggagcucauccagcagcaggcc

SEQ ID NO: 9620 - RNA, 23 nt, Homo sapiens
ggagcucauccagcagcaggccg

SEQ ID NO: 9621 - RNA, 23 nt, Homo sapiens
gagcucauccagcagcaggccgc

SEQ ID NO: 9622 - RNA, 23 nt, Homo sapiens
agcucauccagcagcaggccgca

SEQ ID NO: 9623 - RNA, 23 nt, Homo sapiens
gcucauccagcagcaggccgcag

SEQ ID NO: 9624 - RNA, 23 nt, Homo sapiens
cucauccagcagcaggccgcagg

SEQ ID NO: 9625 - RNA, 23 nt, Homo sapiens
ucauccagcagcaggccgcaggg

SEQ ID NO: 9626 - RNA, 23 nt, Homo sapiens
cauccagcagcaggccgcagggg

SEQ ID NO: 9627 - RNA, 23 nt, Homo sapiens
auccagcagcaggccgcagggga

SEQ ID NO: 9628 - RNA, 23 nt, Homo sapiens
uccagcagcaggccgcaggggag

SEQ ID NO: 9629 - RNA, 23 nt, Homo sapiens
ccagcagcaggccgcaggggagu

SEQ ID NO: 9630 - RNA, 23 nt, Homo sapiens
cagcagcaggccgcaggggagug

SEQ ID NO: 9631 - RNA, 23 nt, Homo sapiens
agcagcaggccgcaggggagugc

SEQ ID NO: 9632 - RNA, 23 nt, Homo sapiens
gcagcaggccgcaggggagugca

SEQ ID NO: 9633 - RNA, 23 nt, Homo sapiens
cagcaggccgcaggggagugcag

SEQ ID NO: 9634 - RNA, 23 nt, Homo sapiens
agcaggccgcaggggagugcaga

SEQ ID NO: 9635 - RNA, 23 nt, Homo sapiens
gcaggccgcaggggagugcagac

SEQ ID NO: 9636 - RNA, 23 nt, Homo sapiens
caggccgcaggggagugcagacc

SEQ ID NO: 9637 - RNA, 23 nt, Homo sapiens
aggccgcaggggagugcagacca

SEQ ID NO: 9638 - RNA, 23 nt, Homo sapiens
ggccgcaggggagugcagaccag

SEQ ID NO: 9639 - RNA, 23 nt, Homo sapiens
gccgcaggggagugcagaccagg

SEQ ID NO: 9640 - RNA, 23 nt, Homo sapiens
ccgcaggggagugcagaccaggg

SEQ ID NO: 9641 - RNA, 23 nt, Homo sapiens
cgcaggggagugcagaccagggc

SEQ ID NO: 9642 - RNA, 23 nt, Homo sapiens
gcaggggagugcagaccagggcg

SEQ ID NO: 9643 - RNA, 23 nt, Homo sapiens
caggggagugcagaccagggcgc

SEQ ID NO: 9644 - RNA, 23 nt, Homo sapiens
aggggagugcagaccagggcgcc

SEQ ID NO: 9645 - RNA, 23 nt, Homo sapiens
ggggagugcagaccagggcgccg

SEQ ID NO: 9646 - RNA, 23 nt, Homo sapiens
gggagugcagaccagggcgccgg

SEQ ID NO: 9647 - RNA, 23 nt, Homo sapiens
ggagugcagaccagggcgccggc

SEQ ID NO: 9648 - RNA, 23 nt, Homo sapiens
gagugcagaccagggcgccggcu

SEQ ID NO: 9649 - RNA, 23 nt, Homo sapiens
agugcagaccagggcgccggcuc

SEQ ID NO: 9650 - RNA, 23 nt, Homo sapiens
gugcagaccagggcgccggcucc

SEQ ID NO: 9651 - RNA, 23 nt, Homo sapiens
ugcagaccagggcgccggcuccu

SEQ ID NO: 9652 - RNA, 23 nt, Homo sapiens
gcagaccagggcgccggcuccug

SEQ ID NO: 9653 - RNA, 23 nt, Homo sapiens
cagaccagggcgccggcuccugg

SEQ ID NO: 9654 - RNA, 23 nt, Homo sapiens
agaccagggcgccggcuccugga

SEQ ID NO: 9655 - RNA, 23 nt, Homo sapiens
gaccagggcgccggcuccuggag

SEQ ID NO: 9656 - RNA, 23 nt, Homo sapiens
accagggcgccggcuccuggagc

SEQ ID NO: 9657 - RNA, 23 nt, Homo sapiens
ccagggcgccggcuccuggagcg

SEQ ID NO: 9658 - RNA, 23 nt, Homo sapiens
cagggcgccggcuccuggagcgc

SEQ ID NO: 9659 - RNA, 23 nt, Homo sapiens
agggcgccggcuccuggagcgcc

SEQ ID NO: 9660 - RNA, 23 nt, Homo sapiens
gggcgccggcuccuggagcgccu

SEQ ID NO: 9661 - RNA, 23 nt, Homo sapiens
ggcgccggcuccuggagcgccug

SEQ ID NO: 9662 - RNA, 23 nt, Homo sapiens
gcgccggcuccuggagcgccugg

SEQ ID NO: 9663 - RNA, 23 nt, Homo sapiens
cgccggcuccuggagcgccuggg

SEQ ID NO: 9664 - RNA, 23 nt, Homo sapiens
gccggcuccuggagcgccuggga

SEQ ID NO: 9665 - RNA, 23 nt, Homo sapiens
ccggcuccuggagcgccugggag

SEQ ID NO: 9666 - RNA, 23 nt, Homo sapiens
cggcuccuggagcgccugggagg

SEQ ID NO: 9667 - RNA, 23 nt, Homo sapiens
ggcuccuggagcgccugggaggg

SEQ ID NO: 9668 - RNA, 23 nt, Homo sapiens
gcuccuggagcgccugggagggc

SEQ ID NO: 9669 - RNA, 23 nt, Homo sapiens
cuccuggagcgccugggagggcg

SEQ ID NO: 9670 - RNA, 23 nt, Homo sapiens
uccuggagcgccugggagggcgc

SEQ ID NO: 9671 - RNA, 23 nt, Homo sapiens
ccuggagcgccugggagggcgcc

SEQ ID NO: 9672 - RNA, 23 nt, Homo sapiens
cuggagcgccugggagggcgccg

SEQ ID NO: 9673 - RNA, 23 nt, Homo sapiens
uggagcgccugggagggcgccgg

SEQ ID NO: 9674 - RNA, 23 nt, Homo sapiens
ggagcgccugggagggcgccggg

SEQ ID NO: 9675 - RNA, 23 nt, Homo sapiens
gagcgccugggagggcgccggga

SEQ ID NO: 9676 - RNA, 23 nt, Homo sapiens
agcgccugggagggcgccgggau

SEQ ID NO: 9677 - RNA, 23 nt, Homo sapiens
gcgccugggagggcgccgggaug

SEQ ID NO: 9678 - RNA, 23 nt, Homo sapiens
cgccugggagggcgccgggaugc

SEQ ID NO: 9679 - RNA, 23 nt, Homo sapiens
gccugggagggcgccgggaugcc

SEQ ID NO: 9680 - RNA, 23 nt, Homo sapiens
ccugggagggcgccgggaugccu

SEQ ID NO: 9681 - RNA, 23 nt, Homo sapiens
cugggagggcgccgggaugccuu

SEQ ID NO: 9682 - RNA, 23 nt, Homo sapiens
ugggagggcgccgggaugccuug

SEQ ID NO: 9683 - RNA, 23 nt, Homo sapiens
gggagggcgccgggaugccuugc

SEQ ID NO: 9684 - RNA, 23 nt, Homo sapiens
ggagggcgccgggaugccuugca

SEQ ID NO: 9685 - RNA, 23 nt, Homo sapiens
gagggcgccgggaugccuugcau

SEQ ID NO: 9686 - RNA, 23 nt, Homo sapiens
agggcgccgggaugccuugcauc

SEQ ID NO: 9687 - RNA, 23 nt, Homo sapiens
gggcgccgggaugccuugcaucu

SEQ ID NO: 9688 - RNA, 23 nt, Homo sapiens
ggcgccgggaugccuugcaucug

SEQ ID NO: 9689 - RNA, 23 nt, Homo sapiens
gcgccgggaugccuugcaucugc

SEQ ID NO: 9690 - RNA, 23 nt, Homo sapiens
cgccgggaugccuugcaucugcc

SEQ ID NO: 9691 - RNA, 23 nt, Homo sapiens
gccgggaugccuugcaucugccc

SEQ ID NO: 9692 - RNA, 23 nt, Homo sapiens
ccgggaugccuugcaucugcccc

SEQ ID NO: 9693 - RNA, 23 nt, Homo sapiens
cgggaugccuugcaucugccccu

SEQ ID NO: 9694 - RNA, 23 nt, Homo sapiens
gggaugccuugcaucugccccug

SEQ ID NO: 9695 - RNA, 23 nt, Homo sapiens
ggaugccuugcaucugccccugc

SEQ ID NO: 9696 - RNA, 23 nt, Homo sapiens
gaugccuugcaucugccccugcc

SEQ ID NO: 9697 - RNA, 23 nt, Homo sapiens
augccuugcaucugccccugccg

SEQ ID NO: 9698 - RNA, 23 nt, Homo sapiens
ugccuugcaucugccccugccgc

SEQ ID NO: 9699 - RNA, 23 nt, Homo sapiens
gccuugcaucugccccugccgcg

SEQ ID NO: 9700 - RNA, 23 nt, Homo sapiens
ccuugcaucugccccugccgcgc

SEQ ID NO: 9701 - RNA, 23 nt, Homo sapiens
cuugcaucugccccugccgcgcg

SEQ ID NO: 9702 - RNA, 23 nt, Homo sapiens
uugcaucugccccugccgcgcgg

SEQ ID NO: 9703 - RNA, 23 nt, Homo sapiens
ugcaucugccccugccgcgcgga

SEQ ID NO: 9704 - RNA, 23 nt, Homo sapiens
gcaucugccccugccgcgcggag

SEQ ID NO: 9705 - RNA, 23 nt, Homo sapiens
caucugccccugccgcgcggagg

SEQ ID NO: 9706 - RNA, 23 nt, Homo sapiens
aucugccccugccgcgcggaggc

SEQ ID NO: 9707 - RNA, 23 nt, Homo sapiens
ucugccccugccgcgcggaggcg

SEQ ID NO: 9708 - RNA, 23 nt, Homo sapiens
cugccccugccgcgcggaggcgg

SEQ ID NO: 9709 - RNA, 23 nt, Homo sapiens
ugccccugccgcgcggaggcgga

SEQ ID NO: 9710 - RNA, 23 nt, Homo sapiens
gccccugccgcgcggaggcggag

SEQ ID NO: 9711 - RNA, 23 nt, Homo sapiens
ccccugccgcgcggaggcggagg

SEQ ID NO: 9712 - RNA, 23 nt, Homo sapiens
cccugccgcgcggaggcggaggc

SEQ ID NO: 9713 - RNA, 23 nt, Homo sapiens
ccugccgcgcggaggcggaggcg

SEQ ID NO: 9714 - RNA, 23 nt, Homo sapiens
cugccgcgcggaggcggaggcgu

SEQ ID NO: 9715 - RNA, 23 nt, Homo sapiens
ugccgcgcggaggcggaggcguc

SEQ ID NO: 9716 - RNA, 23 nt, Homo sapiens
gccgcgcggaggcggaggcgucc

SEQ ID NO: 9717 - RNA, 23 nt, Homo sapiens
ccgcgcggaggcggaggcguccg

SEQ ID NO: 9718 - RNA, 23 nt, Homo sapiens
cgcgcggaggcggaggcguccgg

SEQ ID NO: 9719 - RNA, 23 nt, Homo sapiens
gcgcggaggcggaggcguccggg

SEQ ID NO: 9720 - RNA, 23 nt, Homo sapiens
cgcggaggcggaggcguccgggg

SEQ ID NO: 9721 - RNA, 23 nt, Homo sapiens
gcggaggcggaggcguccggggg

SEQ ID NO: 9722 - RNA, 23 nt, Homo sapiens
cggaggcggaggcguccgggggc

SEQ ID NO: 9723 - RNA, 23 nt, Homo sapiens
ggaggcggaggcguccgggggcg

SEQ ID NO: 9724 - RNA, 23 nt, Homo sapiens
gaggcggaggcguccgggggcgc

SEQ ID NO: 9725 - RNA, 23 nt, Homo sapiens
aggcggaggcguccgggggcgcg

SEQ ID NO: 9726 - RNA, 23 nt, Homo sapiens
ggcggaggcguccgggggcgcgg

SEQ ID NO: 9727 - RNA, 23 nt, Homo sapiens
gcggaggcguccgggggcgcggg

SEQ ID NO: 9728 - RNA, 23 nt, Homo sapiens
cggaggcguccgggggcgcgggc

SEQ ID NO: 9729 - RNA, 23 nt, Homo sapiens
ggaggcguccgggggcgcgggcu

SEQ ID NO: 9730 - RNA, 23 nt, Homo sapiens
gaggcguccgggggcgcgggcug

SEQ ID NO: 9731 - RNA, 23 nt, Homo sapiens
aggcguccgggggcgcgggcugg

SEQ ID NO: 9732 - RNA, 23 nt, Homo sapiens
ggcguccgggggcgcgggcuggg

SEQ ID NO: 9733 - RNA, 23 nt, Homo sapiens
gcguccgggggcgcgggcugggg

SEQ ID NO: 9734 - RNA, 23 nt, Homo sapiens
cguccgggggcgcgggcugggga

SEQ ID NO: 9735 - RNA, 23 nt, Homo sapiens
guccgggggcgcgggcuggggag

SEQ ID NO: 9736 - RNA, 23 nt, Homo sapiens
uccgggggcgcgggcuggggagg

SEQ ID NO: 9737 - RNA, 23 nt, Homo sapiens
ccgggggcgcgggcuggggaggu

SEQ ID NO: 9738 - RNA, 23 nt, Homo sapiens
cgggggcgcgggcuggggaggug

SEQ ID NO: 9739 - RNA, 23 nt, Homo sapiens
gggggcgcgggcuggggaggugg

SEQ ID NO: 9740 - RNA, 23 nt, Homo sapiens
ggggcgcgggcuggggaggugga

SEQ ID NO: 9741 - RNA, 23 nt, Homo sapiens
gggcgcgggcuggggagguggag

SEQ ID NO: 9742 - RNA, 23 nt, Homo sapiens
ggcgcgggcuggggagguggagc

SEQ ID NO: 9743 - RNA, 23 nt, Homo sapiens
gcgcgggcuggggagguggagcu

SEQ ID NO: 9744 - RNA, 23 nt, Homo sapiens
cgcgggcuggggagguggagcug

SEQ ID NO: 9745 - RNA, 23 nt, Homo sapiens
gcgggcuggggagguggagcugc

SEQ ID NO: 9746 - RNA, 23 nt, Homo sapiens
cgggcuggggagguggagcugcc

SEQ ID NO: 9747 - RNA, 23 nt, Homo sapiens
gggcuggggagguggagcugccc

SEQ ID NO: 9748 - RNA, 23 nt, Homo sapiens
ggcuggggagguggagcugcccc

SEQ ID NO: 9749 - RNA, 23 nt, Homo sapiens
gcuggggagguggagcugccccg

SEQ ID NO: 9750 - RNA, 23 nt, Homo sapiens
cuggggagguggagcugccccgg

SEQ ID NO: 9751 - RNA, 23 nt, Homo sapiens
uggggagguggagcugccccggc

SEQ ID NO: 9752 - RNA, 23 nt, Homo sapiens
ggggagguggagcugccccggcu

SEQ ID NO: 9753 - RNA, 23 nt, Homo sapiens
gggagguggagcugccccggcuu

SEQ ID NO: 9754 - RNA, 23 nt, Homo sapiens
ggagguggagcugccccggcuug

SEQ ID NO: 9755 - RNA, 23 nt, Homo sapiens
gagguggagcugccccggcuugg

SEQ ID NO: 9756 - RNA, 23 nt, Homo sapiens
agguggagcugccccggcuuggg

SEQ ID NO: 9757 - RNA, 23 nt, Homo sapiens
gguggagcugccccggcuugggg

SEQ ID NO: 9758 - RNA, 23 nt, Homo sapiens
guggagcugccccggcuuggggu

SEQ ID NO: 9759 - RNA, 23 nt, Homo sapiens
uggagcugccccggcuugggguu

SEQ ID NO: 9760 - RNA, 23 nt, Homo sapiens
ggagcugccccggcuugggguuc

SEQ ID NO: 9761 - RNA, 23 nt, Homo sapiens
gagcugccccggcuugggguucc

SEQ ID NO: 9762 - RNA, 23 nt, Homo sapiens
agcugccccggcuugggguuccc

SEQ ID NO: 9763 - RNA, 23 nt, Homo sapiens
gcugccccggcuugggguuccca

SEQ ID NO: 9764 - RNA, 23 nt, Homo sapiens
cugccccggcuugggguucccac

SEQ ID NO: 9765 - RNA, 23 nt, Homo sapiens
ugccccggcuugggguucccacg

SEQ ID NO: 9766 - RNA, 23 nt, Homo sapiens
gccccggcuugggguucccacgc

SEQ ID NO: 9767 - RNA, 23 nt, Homo sapiens
ccccggcuugggguucccacgcc

SEQ ID NO: 9768 - RNA, 23 nt, Homo sapiens
cccggcuugggguucccacgccg

SEQ ID NO: 9769 - RNA, 23 nt, Homo sapiens
ccggcuugggguucccacgccgc

SEQ ID NO: 9770 - RNA, 23 nt, Homo sapiens
cggcuugggguucccacgccgcc

SEQ ID NO: 9771 - RNA, 23 nt, Homo sapiens
ggcuugggguucccacgccgccc

SEQ ID NO: 9772 - RNA, 23 nt, Homo sapiens
gcuugggguucccacgccgcccc

SEQ ID NO: 9773 - RNA, 23 nt, Homo sapiens
cuugggguucccacgccgccccg

SEQ ID NO: 9774 - RNA, 23 nt, Homo sapiens
uugggguucccacgccgccccgg

SEQ ID NO: 9775 - RNA, 23 nt, Homo sapiens
ugggguucccacgccgccccggc

SEQ ID NO: 9776 - RNA, 23 nt, Homo sapiens
gggguucccacgccgccccggcg

SEQ ID NO: 9777 - RNA, 23 nt, Homo sapiens
ggguucccacgccgccccggcga

SEQ ID NO: 9778 - RNA, 23 nt, Homo sapiens
gguucccacgccgccccggcgac

SEQ ID NO: 9779 - RNA, 23 nt, Homo sapiens
guucccacgccgccccggcgacc

SEQ ID NO: 9780 - RNA, 23 nt, Homo sapiens
uucccacgccgccccggcgaccu

SEQ ID NO: 9781 - RNA, 23 nt, Homo sapiens
ucccacgccgccccggcgaccug

SEQ ID NO: 9782 - RNA, 23 nt, Homo sapiens
cccacgccgccccggcgaccugg

SEQ ID NO: 9783 - RNA, 23 nt, Homo sapiens
ccacgccgccccggcgaccuggg

SEQ ID NO: 9784 - RNA, 23 nt, Homo sapiens
cacgccgccccggcgaccugggg

SEQ ID NO: 9785 - RNA, 23 nt, Homo sapiens
acgccgccccggcgaccugggga

SEQ ID NO: 9786 - RNA, 23 nt, Homo sapiens
cgccgccccggcgaccuggggac

SEQ ID NO: 9787 - RNA, 23 nt, Homo sapiens
gccgccccggcgaccuggggacc

SEQ ID NO: 9788 - RNA, 23 nt, Homo sapiens
ccgccccggcgaccuggggaccc

SEQ ID NO: 9789 - RNA, 23 nt, Homo sapiens
cgccccggcgaccuggggacccc

SEQ ID NO: 9790 - RNA, 23 nt, Homo sapiens
gccccggcgaccuggggaccccg

SEQ ID NO: 9791 - RNA, 23 nt, Homo sapiens
ccccggcgaccuggggaccccgg

SEQ ID NO: 9792 - RNA, 23 nt, Homo sapiens
cccggcgaccuggggaccccggc

SEQ ID NO: 9793 - RNA, 23 nt, Homo sapiens
ccggcgaccuggggaccccggcc

SEQ ID NO: 9794 - RNA, 23 nt, Homo sapiens
cggcgaccuggggaccccggccc

SEQ ID NO: 9795 - RNA, 23 nt, Homo sapiens
ggcgaccuggggaccccggcccc

SEQ ID NO: 9796 - RNA, 23 nt, Homo sapiens
gcgaccuggggaccccggcccca

SEQ ID NO: 9797 - RNA, 23 nt, Homo sapiens
cgaccuggggaccccggccccag

SEQ ID NO: 9798 - RNA, 23 nt, Homo sapiens
gaccuggggaccccggccccagc

SEQ ID NO: 9799 - RNA, 23 nt, Homo sapiens
accuggggaccccggccccagcc

SEQ ID NO: 9800 - RNA, 23 nt, Homo sapiens
ccuggggaccccggccccagccc

SEQ ID NO: 9801 - RNA, 23 nt, Homo sapiens
cuggggaccccggccccagcccc

SEQ ID NO: 9802 - RNA, 23 nt, Homo sapiens
uggggaccccggccccagcccca

SEQ ID NO: 9803 - RNA, 23 nt, Homo sapiens
ggggaccccggccccagccccac

SEQ ID NO: 9804 - RNA, 23 nt, Homo sapiens
gggaccccggccccagccccacc

SEQ ID NO: 9805 - RNA, 23 nt, Homo sapiens
ggaccccggccccagccccacca

SEQ ID NO: 9806 - RNA, 23 nt, Homo sapiens
gaccccggccccagccccaccac

SEQ ID NO: 9807 - RNA, 23 nt, Homo sapiens
accccggccccagccccaccacg

SEQ ID NO: 9808 - RNA, 23 nt, Homo sapiens
ccccggccccagccccaccacgg

SEQ ID NO: 9809 - RNA, 23 nt, Homo sapiens
cccggccccagccccaccacgga

SEQ ID NO: 9810 - RNA, 23 nt, Homo sapiens
ccggccccagccccaccacggac

SEQ ID NO: 9811 - RNA, 23 nt, Homo sapiens
cggccccagccccaccacggacu

SEQ ID NO: 9812 - RNA, 23 nt, Homo sapiens
ggccccagccccaccacggacuc

SEQ ID NO: 9813 - RNA, 23 nt, Homo sapiens
gccccagccccaccacggacucc

SEQ ID NO: 9814 - RNA, 23 nt, Homo sapiens
ccccagccccaccacggacuccc

SEQ ID NO: 9815 - RNA, 23 nt, Homo sapiens
cccagccccaccacggacucccc

SEQ ID NO: 9816 - RNA, 23 nt, Homo sapiens
ccagccccaccacggacuccccu

SEQ ID NO: 9817 - RNA, 23 nt, Homo sapiens
cagccccaccacggacuccccug

SEQ ID NO: 9818 - RNA, 23 nt, Homo sapiens
agccccaccacggacuccccugg

SEQ ID NO: 9819 - RNA, 23 nt, Homo sapiens
gccccaccacggacuccccuggg

SEQ ID NO: 9820 - RNA, 23 nt, Homo sapiens
ccccaccacggacuccccuggga

SEQ ID NO: 9821 - RNA, 23 nt, Homo sapiens
cccaccacggacuccccugggac

SEQ ID NO: 9822 - RNA, 23 nt, Homo sapiens
ccaccacggacuccccugggacg

SEQ ID NO: 9823 - RNA, 23 nt, Homo sapiens
caccacggacuccccugggacgu

SEQ ID NO: 9824 - RNA, 23 nt, Homo sapiens
accacggacuccccugggacgug

SEQ ID NO: 9825 - RNA, 23 nt, Homo sapiens
ccacggacuccccugggacgugg

SEQ ID NO: 9826 - RNA, 23 nt, Homo sapiens
cacggacuccccugggacguggg

SEQ ID NO: 9827 - RNA, 23 nt, Homo sapiens
acggacuccccugggacgugggu

SEQ ID NO: 9828 - RNA, 23 nt, Homo sapiens
cggacuccccugggacgugggug

SEQ ID NO: 9829 - RNA, 23 nt, Homo sapiens
ggacuccccugggacgugggugg

SEQ ID NO: 9830 - RNA, 23 nt, Homo sapiens
gacuccccugggacguggguggc

SEQ ID NO: 9831 - RNA, 23 nt, Homo sapiens
acuccccugggacguggguggcg

SEQ ID NO: 9832 - RNA, 23 nt, Homo sapiens
cuccccugggacguggguggcgc

SEQ ID NO: 9833 - RNA, 23 nt, Homo sapiens
uccccugggacguggguggcgca

SEQ ID NO: 9834 - RNA, 23 nt, Homo sapiens
ccccugggacguggguggcgcaa

SEQ ID NO: 9835 - RNA, 23 nt, Homo sapiens
cccugggacguggguggcgcaag

SEQ ID NO: 9836 - RNA, 23 nt, Homo sapiens
ccugggacguggguggcgcaagc

SEQ ID NO: 9837 - RNA, 23 nt, Homo sapiens
cugggacguggguggcgcaagca

SEQ ID NO: 9838 - RNA, 23 nt, Homo sapiens
ugggacguggguggcgcaagcac

SEQ ID NO: 9839 - RNA, 23 nt, Homo sapiens
gggacguggguggcgcaagcacc

SEQ ID NO: 9840 - RNA, 23 nt, Homo sapiens
ggacguggguggcgcaagcaccc

SEQ ID NO: 9841 - RNA, 23 nt, Homo sapiens
gacguggguggcgcaagcacccc

SEQ ID NO: 9842 - RNA, 23 nt, Homo sapiens
acguggguggcgcaagcaccccu

SEQ ID NO: 9843 - RNA, 23 nt, Homo sapiens
cguggguggcgcaagcaccccuu

SEQ ID NO: 9844 - RNA, 23 nt, Homo sapiens
guggguggcgcaagcaccccuug

SEQ ID NO: 9845 - RNA, 23 nt, Homo sapiens
uggguggcgcaagcaccccuugg

SEQ ID NO: 9846 - RNA, 23 nt, Homo sapiens
ggguggcgcaagcaccccuuggc

SEQ ID NO: 9847 - RNA, 23 nt, Homo sapiens
gguggcgcaagcaccccuuggcc

SEQ ID NO: 9848 - RNA, 23 nt, Homo sapiens
guggcgcaagcaccccuuggccc

SEQ ID NO: 9849 - RNA, 23 nt, Homo sapiens
uggcgcaagcaccccuuggcccu

SEQ ID NO: 9850 - RNA, 23 nt, Homo sapiens
ggcgcaagcaccccuuggcccug

SEQ ID NO: 9851 - RNA, 23 nt, Homo sapiens
gcgcaagcaccccuuggcccugc

SEQ ID NO: 9852 - RNA, 23 nt, Homo sapiens
cgcaagcaccccuuggcccugcg

SEQ ID NO: 9853 - RNA, 23 nt, Homo sapiens
gcaagcaccccuuggcccugcgg

SEQ ID NO: 9854 - RNA, 23 nt, Homo sapiens
caagcaccccuuggcccugcggc

SEQ ID NO: 9855 - RNA, 23 nt, Homo sapiens
aagcaccccuuggcccugcggcc

SEQ ID NO: 9856 - RNA, 23 nt, Homo sapiens
agcaccccuuggcccugcggccc

SEQ ID NO: 9857 - RNA, 23 nt, Homo sapiens
gcaccccuuggcccugcggcccc

SEQ ID NO: 9858 - RNA, 23 nt, Homo sapiens
caccccuuggcccugcggccccg

SEQ ID NO: 9859 - RNA, 23 nt, Homo sapiens
accccuuggcccugcggccccgc

SEQ ID NO: 9860 - RNA, 23 nt, Homo sapiens
ccccuuggcccugcggccccgcu

SEQ ID NO: 9861 - RNA, 23 nt, Homo sapiens
cccuuggcccugcggccccgcuu

SEQ ID NO: 9862 - RNA, 23 nt, Homo sapiens
ccuuggcccugcggccccgcuug

SEQ ID NO: 9863 - RNA, 23 nt, Homo sapiens
cuuggcccugcggccccgcuuga

SEQ ID NO: 9864 - RNA, 23 nt, Homo sapiens
uuggcccugcggccccgcuugag

SEQ ID NO: 9865 - RNA, 23 nt, Homo sapiens
uggcccugcggccccgcuugagc

SEQ ID NO: 9866 - RNA, 23 nt, Homo sapiens
ggcccugcggccccgcuugagcg

SEQ ID NO: 9867 - RNA, 23 nt, Homo sapiens
gcccugcggccccgcuugagcgg

SEQ ID NO: 9868 - RNA, 23 nt, Homo sapiens
cccugcggccccgcuugagcggg

SEQ ID NO: 9869 - RNA, 23 nt, Homo sapiens
ccugcggccccgcuugagcgggc

SEQ ID NO: 9870 - RNA, 23 nt, Homo sapiens
cugcggccccgcuugagcgggcc

SEQ ID NO: 9871 - RNA, 23 nt, Homo sapiens
ugcggccccgcuugagcgggccc

SEQ ID NO: 9872 - RNA, 23 nt, Homo sapiens
gcggccccgcuugagcgggccca

SEQ ID NO: 9873 - RNA, 23 nt, Homo sapiens
cggccccgcuugagcgggcccag

SEQ ID NO: 9874 - RNA, 23 nt, Homo sapiens
ggccccgcuugagcgggcccagg

SEQ ID NO: 9875 - RNA, 23 nt, Homo sapiens
gccccgcuugagcgggcccaggc

SEQ ID NO: 9876 - RNA, 23 nt, Homo sapiens
ccccgcuugagcgggcccaggcu

SEQ ID NO: 9877 - RNA, 23 nt, Homo sapiens
cccgcuugagcgggcccaggcug

SEQ ID NO: 9878 - RNA, 23 nt, Homo sapiens
ccgcuugagcgggcccaggcugu

SEQ ID NO: 9879 - RNA, 23 nt, Homo sapiens
cgcuugagcgggcccaggcugug

SEQ ID NO: 9880 - RNA, 23 nt, Homo sapiens
gcuugagcgggcccaggcugugc

SEQ ID NO: 9881 - RNA, 23 nt, Homo sapiens
cuugagcgggcccaggcugugcc

SEQ ID NO: 9882 - RNA, 23 nt, Homo sapiens
uugagcgggcccaggcugugcca

SEQ ID NO: 9883 - RNA, 23 nt, Homo sapiens
ugagcgggcccaggcugugccac

SEQ ID NO: 9884 - RNA, 23 nt, Homo sapiens
gagcgggcccaggcugugccacc

SEQ ID NO: 9885 - RNA, 23 nt, Homo sapiens
agcgggcccaggcugugccaccg

SEQ ID NO: 9886 - RNA, 23 nt, Homo sapiens
gcgggcccaggcugugccaccgc

SEQ ID NO: 9887 - RNA, 23 nt, Homo sapiens
cgggcccaggcugugccaccgcg

SEQ ID NO: 9888 - RNA, 23 nt, Homo sapiens
gggcccaggcugugccaccgcgc

SEQ ID NO: 9889 - RNA, 23 nt, Homo sapiens
ggcccaggcugugccaccgcgca

SEQ ID NO: 9890 - RNA, 23 nt, Homo sapiens
gcccaggcugugccaccgcgcag

SEQ ID NO: 9891 - RNA, 23 nt, Homo sapiens
cccaggcugugccaccgcgcagg

SEQ ID NO: 9892 - RNA, 23 nt, Homo sapiens
ccaggcugugccaccgcgcaggg

SEQ ID NO: 9893 - RNA, 23 nt, Homo sapiens
caggcugugccaccgcgcagggg

SEQ ID NO: 9894 - RNA, 23 nt, Homo sapiens
aggcugugccaccgcgcaggggc

SEQ ID NO: 9895 - RNA, 23 nt, Homo sapiens
ggcugugccaccgcgcaggggcc

SEQ ID NO: 9896 - RNA, 23 nt, Homo sapiens
gcugugccaccgcgcaggggccc

SEQ ID NO: 9897 - RNA, 23 nt, Homo sapiens
cugugccaccgcgcaggggcccg

SEQ ID NO: 9898 - RNA, 23 nt, Homo sapiens
ugugccaccgcgcaggggcccgg

SEQ ID NO: 9899 - RNA, 23 nt, Homo sapiens
gugccaccgcgcaggggcccggc

SEQ ID NO: 9900 - RNA, 23 nt, Homo sapiens
ugccaccgcgcaggggcccggca

SEQ ID NO: 9901 - RNA, 23 nt, Homo sapiens
gccaccgcgcaggggcccggcag

SEQ ID NO: 9902 - RNA, 23 nt, Homo sapiens
ccaccgcgcaggggcccggcagg

SEQ ID NO: 9903 - RNA, 23 nt, Homo sapiens
caccgcgcaggggcccggcaggc

SEQ ID NO: 9904 - RNA, 23 nt, Homo sapiens
accgcgcaggggcccggcaggcc

SEQ ID NO: 9905 - RNA, 23 nt, Homo sapiens
ccgcgcaggggcccggcaggccg

SEQ ID NO: 9906 - RNA, 23 nt, Homo sapiens
cgcgcaggggcccggcaggccgu

SEQ ID NO: 9907 - RNA, 23 nt, Homo sapiens
gcgcaggggcccggcaggccguc

SEQ ID NO: 9908 - RNA, 23 nt, Homo sapiens
cgcaggggcccggcaggccgucg

SEQ ID NO: 9909 - RNA, 23 nt, Homo sapiens
gcaggggcccggcaggccgucgc

SEQ ID NO: 9910 - RNA, 23 nt, Homo sapiens
caggggcccggcaggccgucgcg

SEQ ID NO: 9911 - RNA, 23 nt, Homo sapiens
aggggcccggcaggccgucgcgc

SEQ ID NO: 9912 - RNA, 23 nt, Homo sapiens
ggggcccggcaggccgucgcgcu

SEQ ID NO: 9913 - RNA, 23 nt, Homo sapiens
gggcccggcaggccgucgcgcug

SEQ ID NO: 9914 - RNA, 23 nt, Homo sapiens
ggcccggcaggccgucgcgcugc

SEQ ID NO: 9915 - RNA, 23 nt, Homo sapiens
gcccggcaggccgucgcgcugcg

SEQ ID NO: 9916 - RNA, 23 nt, Homo sapiens
cccggcaggccgucgcgcugcgg

SEQ ID NO: 9917 - RNA, 23 nt, Homo sapiens
ccggcaggccgucgcgcugcggg

SEQ ID NO: 9918 - RNA, 23 nt, Homo sapiens
cggcaggccgucgcgcugcgggu

SEQ ID NO: 9919 - RNA, 23 nt, Homo sapiens
ggcaggccgucgcgcugcggguc

SEQ ID NO: 9920 - RNA, 23 nt, Homo sapiens
gcaggccgucgcgcugcgggucc

SEQ ID NO: 9921 - RNA, 23 nt, Homo sapiens
caggccgucgcgcugcggguccc

SEQ ID NO: 9922 - RNA, 23 nt, Homo sapiens
aggccgucgcgcugcgggucccg

SEQ ID NO: 9923 - RNA, 23 nt, Homo sapiens
ggccgucgcgcugcgggucccgg

SEQ ID NO: 9924 - RNA, 23 nt, Homo sapiens
gccgucgcgcugcgggucccggu

SEQ ID NO: 9925 - RNA, 23 nt, Homo sapiens
ccgucgcgcugcgggucccgguc

SEQ ID NO: 9926 - RNA, 23 nt, Homo sapiens
cgucgcgcugcgggucccggucc

SEQ ID NO: 9927 - RNA, 23 nt, Homo sapiens
gucgcgcugcgggucccgguccu

SEQ ID NO: 9928 - RNA, 23 nt, Homo sapiens
ucgcgcugcgggucccgguccuc

SEQ ID NO: 9929 - RNA, 23 nt, Homo sapiens
cgcgcugcgggucccgguccucc

SEQ ID NO: 9930 - RNA, 23 nt, Homo sapiens
gcgcugcgggucccgguccuccc

SEQ ID NO: 9931 - RNA, 23 nt, Homo sapiens
cgcugcgggucccgguccucccg

SEQ ID NO: 9932 - RNA, 23 nt, Homo sapiens
gcugcgggucccgguccucccgg

SEQ ID NO: 9933 - RNA, 23 nt, Homo sapiens
cugcgggucccgguccucccggc

SEQ ID NO: 9934 - RNA, 23 nt, Homo sapiens
ugcgggucccgguccucccggcu

SEQ ID NO: 9935 - RNA, 23 nt, Homo sapiens
gcgggucccgguccucccggcuu

SEQ ID NO: 9936 - RNA, 23 nt, Homo sapiens
cgggucccgguccucccggcuuu

SEQ ID NO: 9937 - RNA, 23 nt, Homo sapiens
gggucccgguccucccggcuuuu

SEQ ID NO: 9938 - RNA, 23 nt, Homo sapiens
ggucccgguccucccggcuuuug

SEQ ID NO: 9939 - RNA, 23 nt, Homo sapiens
gucccgguccucccggcuuuugc

SEQ ID NO: 9940 - RNA, 23 nt, Homo sapiens
ucccgguccucccggcuuuugcc

SEQ ID NO: 9941 - RNA, 23 nt, Homo sapiens
cccgguccucccggcuuuugccc

SEQ ID NO: 9942 - RNA, 23 nt, Homo sapiens
ccgguccucccggcuuuugcccg

SEQ ID NO: 9943 - RNA, 23 nt, Homo sapiens
cgguccucccggcuuuugcccgg

SEQ ID NO: 9944 - RNA, 23 nt, Homo sapiens
gguccucccggcuuuugcccggg

SEQ ID NO: 9945 - RNA, 23 nt, Homo sapiens
guccucccggcuuuugcccgggu

SEQ ID NO: 9946 - RNA, 23 nt, Homo sapiens
uccucccggcuuuugcccgggug

SEQ ID NO: 9947 - RNA, 23 nt, Homo sapiens
ccucccggcuuuugcccgggugc

SEQ ID NO: 9948 - RNA, 23 nt, Homo sapiens
cucccggcuuuugcccgggugcg

SEQ ID NO: 9949 - RNA, 23 nt, Homo sapiens
ucccggcuuuugcccgggugcgg

SEQ ID NO: 9950 - RNA, 23 nt, Homo sapiens
cccggcuuuugcccgggugcgga

SEQ ID NO: 9951 - RNA, 23 nt, Homo sapiens
ccggcuuuugcccgggugcggag

SEQ ID NO: 9952 - RNA, 23 nt, Homo sapiens
cggcuuuugcccgggugcggagg

SEQ ID NO: 9953 - RNA, 23 nt, Homo sapiens
ggcuuuugcccgggugcggaggc

SEQ ID NO: 9954 - RNA, 23 nt, Homo sapiens
gcuuuugcccgggugcggaggcc

SEQ ID NO: 9955 - RNA, 23 nt, Homo sapiens
cuuuugcccgggugcggaggcca

SEQ ID NO: 9956 - RNA, 23 nt, Homo sapiens
uuuugcccgggugcggaggccag

SEQ ID NO: 9957 - RNA, 23 nt, Homo sapiens
uuugcccgggugcggaggccagc

SEQ ID NO: 9958 - RNA, 23 nt, Homo sapiens
uugcccgggugcggaggccagcg

SEQ ID NO: 9959 - RNA, 23 nt, Homo sapiens
ugcccgggugcggaggccagcga

SEQ ID NO: 9960 - RNA, 23 nt, Homo sapiens
gcccgggugcggaggccagcgag

SEQ ID NO: 9961 - RNA, 23 nt, Homo sapiens
cccgggugcggaggccagcgagg

SEQ ID NO: 9962 - RNA, 23 nt, Homo sapiens
ccgggugcggaggccagcgagga

SEQ ID NO: 9963 - RNA, 23 nt, Homo sapiens
cgggugcggaggccagcgaggag

SEQ ID NO: 9964 - RNA, 23 nt, Homo sapiens
gggugcggaggccagcgaggagc

SEQ ID NO: 9965 - RNA, 23 nt, Homo sapiens
ggugcggaggccagcgaggagcc

SEQ ID NO: 9966 - RNA, 23 nt, Homo sapiens
gugcggaggccagcgaggagccu

SEQ ID NO: 9967 - RNA, 23 nt, Homo sapiens
ugcggaggccagcgaggagccug

SEQ ID NO: 9968 - RNA, 23 nt, Homo sapiens
gcggaggccagcgaggagccuga

SEQ ID NO: 9969 - RNA, 23 nt, Homo sapiens
cggaggccagcgaggagccugag

SEQ ID NO: 9970 - RNA, 23 nt, Homo sapiens
ggaggccagcgaggagccugagg

SEQ ID NO: 9971 - RNA, 23 nt, Homo sapiens
gaggccagcgaggagccugaggg

SEQ ID NO: 9972 - RNA, 23 nt, Homo sapiens
aggccagcgaggagccugagggu

SEQ ID NO: 9973 - RNA, 23 nt, Homo sapiens
ggccagcgaggagccugagggug

SEQ ID NO: 9974 - RNA, 23 nt, Homo sapiens
gccagcgaggagccugagggugg

SEQ ID NO: 9975 - RNA, 23 nt, Homo sapiens
ccagcgaggagccugaggguggg

SEQ ID NO: 9976 - RNA, 23 nt, Homo sapiens
cagcgaggagccugaggguggga

SEQ ID NO: 9977 - RNA, 23 nt, Homo sapiens
agcgaggagccugagggugggag

SEQ ID NO: 9978 - RNA, 23 nt, Homo sapiens
gcgaggagccugagggugggaga

SEQ ID NO: 9979 - RNA, 23 nt, Homo sapiens
cgaggagccugagggugggagag

SEQ ID NO: 9980 - RNA, 23 nt, Homo sapiens
gaggagccugagggugggagagc

SEQ ID NO: 9981 - RNA, 23 nt, Homo sapiens
aggagccugagggugggagagcg

SEQ ID NO: 9982 - RNA, 23 nt, Homo sapiens
ggagccugagggugggagagcgc

SEQ ID NO: 9983 - RNA, 23 nt, Homo sapiens
gagccugagggugggagagcgcc

SEQ ID NO: 9984 - RNA, 23 nt, Homo sapiens
agccugagggugggagagcgccc

SEQ ID NO: 9985 - RNA, 23 nt, Homo sapiens
gccugagggugggagagcgcccc

SEQ ID NO: 9986 - RNA, 23 nt, Homo sapiens
ccugagggugggagagcgccccg

SEQ ID NO: 9987 - RNA, 23 nt, Homo sapiens
cugagggugggagagcgccccgu

SEQ ID NO: 9988 - RNA, 23 nt, Homo sapiens
ugagggugggagagcgccccguc

SEQ ID NO: 9989 - RNA, 23 nt, Homo sapiens
gagggugggagagcgccccgucc

SEQ ID NO: 9990 - RNA, 23 nt, Homo sapiens
agggugggagagcgccccguccg

SEQ ID NO: 9991 - RNA, 23 nt, Homo sapiens
gggugggagagcgccccguccgg

SEQ ID NO: 9992 - RNA, 23 nt, Homo sapiens
ggugggagagcgccccguccgga

SEQ ID NO: 9993 - RNA, 23 nt, Homo sapiens
gugggagagcgccccguccggag

SEQ ID NO: 9994 - RNA, 23 nt, Homo sapiens
ugggagagcgccccguccggagg

SEQ ID NO: 9995 - RNA, 23 nt, Homo sapiens
gggagagcgccccguccggagga

SEQ ID NO: 9996 - RNA, 23 nt, Homo sapiens
ggagagcgccccguccggaggag

SEQ ID NO: 9997 - RNA, 23 nt, Homo sapiens
gagagcgccccguccggaggagc

SEQ ID NO: 9998 - RNA, 23 nt, Homo sapiens
agagcgccccguccggaggagcc

SEQ ID NO: 9999 - RNA, 23 nt, Homo sapiens
gagcgccccguccggaggagccg

SEQ ID NO: 10000 - RNA, 23 nt, Homo sapiens
agcgccccguccggaggagccgg

SEQ ID NO: 10001 - RNA, 23 nt, Homo sapiens
gcgccccguccggaggagccggg

SEQ ID NO: 10002 - RNA, 23 nt, Homo sapiens
cgccccguccggaggagccgggg

SEQ ID NO: 10003 - RNA, 23 nt, Homo sapiens
gccccguccggaggagccggggc

SEQ ID NO: 10004 - RNA, 23 nt, Homo sapiens
ccccguccggaggagccggggcg

SEQ ID NO: 10005 - RNA, 23 nt, Homo sapiens
cccguccggaggagccggggcgg

SEQ ID NO: 10006 - RNA, 23 nt, Homo sapiens
ccguccggaggagccggggcggc

SEQ ID NO: 10007 - RNA, 23 nt, Homo sapiens
cguccggaggagccggggcggcg

SEQ ID NO: 10008 - RNA, 23 nt, Homo sapiens
guccggaggagccggggcggcgu

SEQ ID NO: 10009 - RNA, 23 nt, Homo sapiens
uccggaggagccggggcggcgua

SEQ ID NO: 10010 - RNA, 23 nt, Homo sapiens
ccggaggagccggggcggcguag

SEQ ID NO: 10011 - RNA, 23 nt, Homo sapiens
cggaggagccggggcggcguagg

SEQ ID NO: 10012 - RNA, 23 nt, Homo sapiens
ggaggagccggggcggcguaggc

SEQ ID NO: 10013 - RNA, 23 nt, Homo sapiens
gaggagccggggcggcguaggcg

SEQ ID NO: 10014 - RNA, 23 nt, Homo sapiens
aggagccggggcggcguaggcga

SEQ ID NO: 10015 - RNA, 23 nt, Homo sapiens
ggagccggggcggcguaggcgaa

SEQ ID NO: 10016 - RNA, 23 nt, Homo sapiens
gagccggggcggcguaggcgaaa

SEQ ID NO: 10017 - RNA, 23 nt, Homo sapiens
agccggggcggcguaggcgaaau

SEQ ID NO: 10018 - RNA, 23 nt, Homo sapiens
gccggggcggcguaggcgaaauc

SEQ ID NO: 10019 - RNA, 23 nt, Homo sapiens
ccggggcggcguaggcgaaaucc

SEQ ID NO: 10020 - RNA, 23 nt, Homo sapiens
cggggcggcguaggcgaaauccc

SEQ ID NO: 10021 - RNA, 23 nt, Homo sapiens
ggggcggcguaggcgaaaucccc

SEQ ID NO: 10022 - RNA, 23 nt, Homo sapiens
gggcggcguaggcgaaauccccg

SEQ ID NO: 10023 - RNA, 23 nt, Homo sapiens
ggcggcguaggcgaaauccccgc

SEQ ID NO: 10024 - RNA, 23 nt, Homo sapiens
gcggcguaggcgaaauccccgcg

SEQ ID NO: 10025 - RNA, 23 nt, Homo sapiens
cggcguaggcgaaauccccgcgc

SEQ ID NO: 10026 - RNA, 23 nt, Homo sapiens
ggcguaggcgaaauccccgcgcg

SEQ ID NO: 10027 - RNA, 23 nt, Homo sapiens
gcguaggcgaaauccccgcgcgc

SEQ ID NO: 10028 - RNA, 23 nt, Homo sapiens
cguaggcgaaauccccgcgcgcc

SEQ ID NO: 10029 - RNA, 23 nt, Homo sapiens
guaggcgaaauccccgcgcgccg

SEQ ID NO: 10030 - RNA, 23 nt, Homo sapiens
uaggcgaaauccccgcgcgccgg

SEQ ID NO: 10031 - RNA, 23 nt, Homo sapiens
aggcgaaauccccgcgcgccggg

SEQ ID NO: 10032 - RNA, 23 nt, Homo sapiens
ggcgaaauccccgcgcgccgggg

SEQ ID NO: 10033 - RNA, 23 nt, Homo sapiens
gcgaaauccccgcgcgccggggc

SEQ ID NO: 10034 - RNA, 23 nt, Homo sapiens
cgaaauccccgcgcgccggggca

SEQ ID NO: 10035 - RNA, 23 nt, Homo sapiens
gaaauccccgcgcgccggggcag

SEQ ID NO: 10036 - RNA, 23 nt, Homo sapiens
aaauccccgcgcgccggggcagg

SEQ ID NO: 10037 - RNA, 23 nt, Homo sapiens
aauccccgcgcgccggggcaggu

SEQ ID NO: 10038 - RNA, 23 nt, Homo sapiens
auccccgcgcgccggggcagguu

SEQ ID NO: 10039 - RNA, 23 nt, Homo sapiens
uccccgcgcgccggggcagguug

SEQ ID NO: 10040 - RNA, 23 nt, Homo sapiens
ccccgcgcgccggggcagguugg

SEQ ID NO: 10041 - RNA, 23 nt, Homo sapiens
cccgcgcgccggggcagguuggg

SEQ ID NO: 10042 - RNA, 23 nt, Homo sapiens
ccgcgcgccggggcagguuggga

SEQ ID NO: 10043 - RNA, 23 nt, Homo sapiens
cgcgcgccggggcagguugggag

SEQ ID NO: 10044 - RNA, 23 nt, Homo sapiens
gcgcgccggggcagguugggaga

SEQ ID NO: 10045 - RNA, 23 nt, Homo sapiens
cgcgccggggcagguugggagau

SEQ ID NO: 10046 - RNA, 23 nt, Homo sapiens
gcgccggggcagguugggagauc

SEQ ID NO: 10047 - RNA, 23 nt, Homo sapiens
cgccggggcagguugggagaucc

SEQ ID NO: 10048 - RNA, 23 nt, Homo sapiens
gccggggcagguugggagauccc

SEQ ID NO: 10049 - RNA, 23 nt, Homo sapiens
ccggggcagguugggagaucccc

SEQ ID NO: 10050 - RNA, 23 nt, Homo sapiens
cggggcagguugggagauccccu

SEQ ID NO: 10051 - RNA, 23 nt, Homo sapiens
ggggcagguugggagauccccuc

SEQ ID NO: 10052 - RNA, 23 nt, Homo sapiens
gggcagguugggagauccccucu

SEQ ID NO: 10053 - RNA, 23 nt, Homo sapiens
ggcagguugggagauccccucug

SEQ ID NO: 10054 - RNA, 23 nt, Homo sapiens
gcagguugggagauccccucugc

SEQ ID NO: 10055 - RNA, 23 nt, Homo sapiens
cagguugggagauccccucugcc

SEQ ID NO: 10056 - RNA, 23 nt, Homo sapiens
agguugggagauccccucugccg

SEQ ID NO: 10057 - RNA, 23 nt, Homo sapiens
gguugggagauccccucugccgg

SEQ ID NO: 10058 - RNA, 23 nt, Homo sapiens
guugggagauccccucugccggc

SEQ ID NO: 10059 - RNA, 23 nt, Homo sapiens
uugggagauccccucugccggcg

SEQ ID NO: 10060 - RNA, 23 nt, Homo sapiens
ugggagauccccucugccggcgc

SEQ ID NO: 10061 - RNA, 23 nt, Homo sapiens
gggagauccccucugccggcgcg

SEQ ID NO: 10062 - RNA, 23 nt, Homo sapiens
ggagauccccucugccggcgcgg

SEQ ID NO: 10063 - RNA, 23 nt, Homo sapiens
gagauccccucugccggcgcggc

SEQ ID NO: 10064 - RNA, 23 nt, Homo sapiens
agauccccucugccggcgcggcc

SEQ ID NO: 10065 - RNA, 23 nt, Homo sapiens
gauccccucugccggcgcggccu

SEQ ID NO: 10066 - RNA, 23 nt, Homo sapiens
auccccucugccggcgcggccug

SEQ ID NO: 10067 - RNA, 23 nt, Homo sapiens
uccccucugccggcgcggccugg

SEQ ID NO: 10068 - RNA, 23 nt, Homo sapiens
ccccucugccggcgcggccuggc

SEQ ID NO: 10069 - RNA, 23 nt, Homo sapiens
cccucugccggcgcggccuggcu

SEQ ID NO: 10070 - RNA, 23 nt, Homo sapiens
ccucugccggcgcggccuggcug

SEQ ID NO: 10071 - RNA, 23 nt, Homo sapiens
cucugccggcgcggccuggcugg

SEQ ID NO: 10072 - RNA, 23 nt, Homo sapiens
ucugccggcgcggccuggcuggg

SEQ ID NO: 10073 - RNA, 23 nt, Homo sapiens
cugccggcgcggccuggcugggc

SEQ ID NO: 10074 - RNA, 23 nt, Homo sapiens
ugccggcgcggccuggcugggcu

SEQ ID NO: 10075 - RNA, 23 nt, Homo sapiens
gccggcgcggccuggcugggcug

SEQ ID NO: 10076 - RNA, 23 nt, Homo sapiens
ccggcgcggccuggcugggcugc

SEQ ID NO: 10077 - RNA, 23 nt, Homo sapiens
cggcgcggccuggcugggcugca

SEQ ID NO: 10078 - RNA, 23 nt, Homo sapiens
ggcgcggccuggcugggcugcag

SEQ ID NO: 10079 - RNA, 23 nt, Homo sapiens
gcgcggccuggcugggcugcagc

SEQ ID NO: 10080 - RNA, 23 nt, Homo sapiens
cgcggccuggcugggcugcagcg

SEQ ID NO: 10081 - RNA, 23 nt, Homo sapiens
gcggccuggcugggcugcagcgc

SEQ ID NO: 10082 - RNA, 23 nt, Homo sapiens
cggccuggcugggcugcagcgcg

SEQ ID NO: 10083 - RNA, 23 nt, Homo sapiens
ggccuggcugggcugcagcgcgg

SEQ ID NO: 10084 - RNA, 23 nt, Homo sapiens
gccuggcugggcugcagcgcggg

SEQ ID NO: 10085 - RNA, 23 nt, Homo sapiens
ccuggcugggcugcagcgcgggg

SEQ ID NO: 10086 - RNA, 23 nt, Homo sapiens
cuggcugggcugcagcgcggggg

SEQ ID NO: 10087 - RNA, 23 nt, Homo sapiens
uggcugggcugcagcgcgggggc

SEQ ID NO: 10088 - RNA, 23 nt, Homo sapiens
ggcugggcugcagcgcgggggcg

SEQ ID NO: 10089 - RNA, 23 nt, Homo sapiens
gcugggcugcagcgcgggggcgg

SEQ ID NO: 10090 - RNA, 23 nt, Homo sapiens
cugggcugcagcgcgggggcggc

SEQ ID NO: 10091 - RNA, 23 nt, Homo sapiens
ugggcugcagcgcgggggcggcc

SEQ ID NO: 10092 - RNA, 23 nt, Homo sapiens
gggcugcagcgcgggggcggccc

SEQ ID NO: 10093 - RNA, 23 nt, Homo sapiens
ggcugcagcgcgggggcggcccu

SEQ ID NO: 10094 - RNA, 23 nt, Homo sapiens
gcugcagcgcgggggcggcccuc

SEQ ID NO: 10095 - RNA, 23 nt, Homo sapiens
cugcagcgcgggggcggcccucg

SEQ ID NO: 10096 - RNA, 23 nt, Homo sapiens
ugcagcgcgggggcggcccucgc

SEQ ID NO: 10097 - RNA, 23 nt, Homo sapiens
gcagcgcgggggcggcccucgcu

SEQ ID NO: 10098 - RNA, 23 nt, Homo sapiens
cagcgcgggggcggcccucgcug

SEQ ID NO: 10099 - RNA, 23 nt, Homo sapiens
agcgcgggggcggcccucgcugc

SEQ ID NO: 10100 - RNA, 23 nt, Homo sapiens
gcgcgggggcggcccucgcugcc

SEQ ID NO: 10101 - RNA, 23 nt, Homo sapiens
cgcgggggcggcccucgcugccu

SEQ ID NO: 10102 - RNA, 23 nt, Homo sapiens
gcgggggcggcccucgcugccug

SEQ ID NO: 10103 - RNA, 23 nt, Homo sapiens
cgggggcggcccucgcugccugg

SEQ ID NO: 10104 - RNA, 23 nt, Homo sapiens
gggggcggcccucgcugccuggc

SEQ ID NO: 10105 - RNA, 23 nt, Homo sapiens
ggggcggcccucgcugccuggcu

SEQ ID NO: 10106 - RNA, 23 nt, Homo sapiens
gggcggcccucgcugccuggcuc

SEQ ID NO: 10107 - RNA, 23 nt, Homo sapiens
ggcggcccucgcugccuggcuca

SEQ ID NO: 10108 - RNA, 23 nt, Homo sapiens
gcggcccucgcugccuggcucac

SEQ ID NO: 10109 - RNA, 23 nt, Homo sapiens
cggcccucgcugccuggcucacg

SEQ ID NO: 10110 - RNA, 23 nt, Homo sapiens
ggcccucgcugccuggcucacga

SEQ ID NO: 10111 - RNA, 23 nt, Homo sapiens
gcccucgcugccuggcucacgaa

SEQ ID NO: 10112 - RNA, 23 nt, Homo sapiens
cccucgcugccuggcucacgaaa

SEQ ID NO: 10113 - RNA, 23 nt, Homo sapiens
ccucgcugccuggcucacgaaag

SEQ ID NO: 10114 - RNA, 23 nt, Homo sapiens
cucgcugccuggcucacgaaagc

SEQ ID NO: 10115 - RNA, 23 nt, Homo sapiens
ucgcugccuggcucacgaaagcc

SEQ ID NO: 10116 - RNA, 23 nt, Homo sapiens
cgcugccuggcucacgaaagccc

SEQ ID NO: 10117 - RNA, 23 nt, Homo sapiens
gcugccuggcucacgaaagcccc

SEQ ID NO: 10118 - RNA, 23 nt, Homo sapiens
cugccuggcucacgaaagccccc

SEQ ID NO: 10119 - RNA, 23 nt, Homo sapiens
ugccuggcucacgaaagcccccu

SEQ ID NO: 10120 - RNA, 23 nt, Homo sapiens
gccuggcucacgaaagcccccug

SEQ ID NO: 10121 - RNA, 23 nt, Homo sapiens
ccuggcucacgaaagcccccugu

SEQ ID NO: 10122 - RNA, 23 nt, Homo sapiens
cuggcucacgaaagcccccugug

SEQ ID NO: 10123 - RNA, 23 nt, Homo sapiens
uggcucacgaaagcccccugugg

SEQ ID NO: 10124 - RNA, 23 nt, Homo sapiens
ggcucacgaaagcccccuguggg

SEQ ID NO: 10125 - RNA, 23 nt, Homo sapiens
gcucacgaaagcccccuguggga

SEQ ID NO: 10126 - RNA, 23 nt, Homo sapiens
cucacgaaagcccccugugggag

SEQ ID NO: 10127 - RNA, 23 nt, Homo sapiens
ucacgaaagcccccugugggaga

SEQ ID NO: 10128 - RNA, 23 nt, Homo sapiens
cacgaaagcccccugugggagag

SEQ ID NO: 10129 - RNA, 23 nt, Homo sapiens
acgaaagcccccugugggagagc

SEQ ID NO: 10130 - RNA, 23 nt, Homo sapiens
cgaaagcccccugugggagagcc

SEQ ID NO: 10131 - RNA, 23 nt, Homo sapiens
gaaagcccccugugggagagccc

SEQ ID NO: 10132 - RNA, 23 nt, Homo sapiens
aaagcccccugugggagagcccc

SEQ ID NO: 10133 - RNA, 23 nt, Homo sapiens
aagcccccugugggagagcccca

SEQ ID NO: 10134 - RNA, 23 nt, Homo sapiens
agcccccugugggagagccccag

SEQ ID NO: 10135 - RNA, 23 nt, Homo sapiens
gcccccugugggagagccccagg

SEQ ID NO: 10136 - RNA, 23 nt, Homo sapiens
cccccugugggagagccccaggc

SEQ ID NO: 10137 - RNA, 23 nt, Homo sapiens
ccccugugggagagccccaggcg

SEQ ID NO: 10138 - RNA, 23 nt, Homo sapiens
cccugugggagagccccaggcgc

SEQ ID NO: 10139 - RNA, 23 nt, Homo sapiens
ccugugggagagccccaggcgcg

SEQ ID NO: 10140 - RNA, 23 nt, Homo sapiens
cugugggagagccccaggcgcgc

SEQ ID NO: 10141 - RNA, 23 nt, Homo sapiens
ugugggagagccccaggcgcgca

SEQ ID NO: 10142 - RNA, 23 nt, Homo sapiens
gugggagagccccaggcgcgcag

SEQ ID NO: 10143 - RNA, 23 nt, Homo sapiens
ugggagagccccaggcgcgcagg

SEQ ID NO: 10144 - RNA, 23 nt, Homo sapiens
gggagagccccaggcgcgcaggg

SEQ ID NO: 10145 - RNA, 23 nt, Homo sapiens
ggagagccccaggcgcgcagggc

SEQ ID NO: 10146 - RNA, 23 nt, Homo sapiens
gagagccccaggcgcgcagggca

SEQ ID NO: 10147 - RNA, 23 nt, Homo sapiens
agagccccaggcgcgcagggcac

SEQ ID NO: 10148 - RNA, 23 nt, Homo sapiens
gagccccaggcgcgcagggcacg

SEQ ID NO: 10149 - RNA, 23 nt, Homo sapiens
agccccaggcgcgcagggcacgu

SEQ ID NO: 10150 - RNA, 23 nt, Homo sapiens
gccccaggcgcgcagggcacgug

SEQ ID NO: 10151 - RNA, 23 nt, Homo sapiens
ccccaggcgcgcagggcacgugg

SEQ ID NO: 10152 - RNA, 23 nt, Homo sapiens
cccaggcgcgcagggcacguggg

SEQ ID NO: 10153 - RNA, 23 nt, Homo sapiens
ccaggcgcgcagggcacgugggg

SEQ ID NO: 10154 - RNA, 23 nt, Homo sapiens
caggcgcgcagggcacguggggu

SEQ ID NO: 10155 - RNA, 23 nt, Homo sapiens
aggcgcgcagggcacguggggug

SEQ ID NO: 10156 - RNA, 23 nt, Homo sapiens
ggcgcgcagggcacguggggugc

SEQ ID NO: 10157 - RNA, 23 nt, Homo sapiens
gcgcgcagggcacguggggugcg

SEQ ID NO: 10158 - RNA, 23 nt, Homo sapiens
cgcgcagggcacguggggugcgg

SEQ ID NO: 10159 - RNA, 23 nt, Homo sapiens
gcgcagggcacguggggugcggg

SEQ ID NO: 10160 - RNA, 23 nt, Homo sapiens
cgcagggcacguggggugcggga

SEQ ID NO: 10161 - RNA, 23 nt, Homo sapiens
gcagggcacguggggugcgggaa

SEQ ID NO: 10162 - RNA, 23 nt, Homo sapiens
cagggcacguggggugcgggaag

SEQ ID NO: 10163 - RNA, 23 nt, Homo sapiens
agggcacguggggugcgggaagc

SEQ ID NO: 10164 - RNA, 23 nt, Homo sapiens
gggcacguggggugcgggaagcc

SEQ ID NO: 10165 - RNA, 23 nt, Homo sapiens
ggcacguggggugcgggaagccc

SEQ ID NO: 10166 - RNA, 23 nt, Homo sapiens
gcacguggggugcgggaagcccc

SEQ ID NO: 10167 - RNA, 23 nt, Homo sapiens
cacguggggugcgggaagccccg

SEQ ID NO: 10168 - RNA, 23 nt, Homo sapiens
acguggggugcgggaagccccgu

SEQ ID NO: 10169 - RNA, 23 nt, Homo sapiens
cguggggugcgggaagccccguu

SEQ ID NO: 10170 - RNA, 23 nt, Homo sapiens
guggggugcgggaagccccguuc

SEQ ID NO: 10171 - RNA, 23 nt, Homo sapiens
uggggugcgggaagccccguucc

SEQ ID NO: 10172 - RNA, 23 nt, Homo sapiens
ggggugcgggaagccccguuccc

SEQ ID NO: 10173 - RNA, 23 nt, Homo sapiens
gggugcgggaagccccguucccc

SEQ ID NO: 10174 - RNA, 23 nt, Homo sapiens
ggugcgggaagccccguucccca

SEQ ID NO: 10175 - RNA, 23 nt, Homo sapiens
gugcgggaagccccguuccccac

SEQ ID NO: 10176 - RNA, 23 nt, Homo sapiens
ugcgggaagccccguuccccacg

SEQ ID NO: 10177 - RNA, 23 nt, Homo sapiens
gcgggaagccccguuccccacgc

SEQ ID NO: 10178 - RNA, 23 nt, Homo sapiens
cgggaagccccguuccccacgcg

SEQ ID NO: 10179 - RNA, 23 nt, Homo sapiens
gggaagccccguuccccacgcgc

SEQ ID NO: 10180 - RNA, 23 nt, Homo sapiens
ggaagccccguuccccacgcgcc

SEQ ID NO: 10181 - RNA, 23 nt, Homo sapiens
gaagccccguuccccacgcgccg

SEQ ID NO: 10182 - RNA, 23 nt, Homo sapiens
aagccccguuccccacgcgccgg

SEQ ID NO: 10183 - RNA, 23 nt, Homo sapiens
agccccguuccccacgcgccggu

SEQ ID NO: 10184 - RNA, 23 nt, Homo sapiens
gccccguuccccacgcgccggug

SEQ ID NO: 10185 - RNA, 23 nt, Homo sapiens
ccccguuccccacgcgccggugu

SEQ ID NO: 10186 - RNA, 23 nt, Homo sapiens
cccguuccccacgcgccggugug

SEQ ID NO: 10187 - RNA, 23 nt, Homo sapiens
ccguuccccacgcgccggugugg

SEQ ID NO: 10188 - RNA, 23 nt, Homo sapiens
cguuccccacgcgccgguguggg

SEQ ID NO: 10189 - RNA, 23 nt, Homo sapiens
guuccccacgcgccggugugggc

SEQ ID NO: 10190 - RNA, 23 nt, Homo sapiens
uuccccacgcgccggugugggcg

SEQ ID NO: 10191 - RNA, 23 nt, Homo sapiens
uccccacgcgccggugugggcga

SEQ ID NO: 10192 - RNA, 23 nt, Homo sapiens
ccccacgcgccggugugggcgaa

SEQ ID NO: 10193 - RNA, 23 nt, Homo sapiens
cccacgcgccggugugggcgaag

SEQ ID NO: 10194 - RNA, 23 nt, Homo sapiens
ccacgcgccggugugggcgaagg

SEQ ID NO: 10195 - RNA, 23 nt, Homo sapiens
cacgcgccggugugggcgaaggc

SEQ ID NO: 10196 - RNA, 23 nt, Homo sapiens
acgcgccggugugggcgaaggcg

SEQ ID NO: 10197 - RNA, 23 nt, Homo sapiens
cgcgccggugugggcgaaggcga

SEQ ID NO: 10198 - RNA, 23 nt, Homo sapiens
gcgccggugugggcgaaggcgac

SEQ ID NO: 10199 - RNA, 23 nt, Homo sapiens
cgccggugugggcgaaggcgacc

SEQ ID NO: 10200 - RNA, 23 nt, Homo sapiens
gccggugugggcgaaggcgaccc

SEQ ID NO: 10201 - RNA, 23 nt, Homo sapiens
ccggugugggcgaaggcgaccca

SEQ ID NO: 10202 - RNA, 23 nt, Homo sapiens
cggugugggcgaaggcgacccac

SEQ ID NO: 10203 - RNA, 23 nt, Homo sapiens
ggugugggcgaaggcgacccacg

SEQ ID NO: 10204 - RNA, 23 nt, Homo sapiens
gugugggcgaaggcgacccacga

SEQ ID NO: 10205 - RNA, 23 nt, Homo sapiens
ugugggcgaaggcgacccacgag

SEQ ID NO: 10206 - RNA, 23 nt, Homo sapiens
gugggcgaaggcgacccacgagg

SEQ ID NO: 10207 - RNA, 23 nt, Homo sapiens
ugggcgaaggcgacccacgaggg

SEQ ID NO: 10208 - RNA, 23 nt, Homo sapiens
gggcgaaggcgacccacgaggga

SEQ ID NO: 10209 - RNA, 23 nt, Homo sapiens
ggcgaaggcgacccacgagggag

SEQ ID NO: 10210 - RNA, 23 nt, Homo sapiens
gcgaaggcgacccacgagggagc

SEQ ID NO: 10211 - RNA, 23 nt, Homo sapiens
cgaaggcgacccacgagggagca

SEQ ID NO: 10212 - RNA, 23 nt, Homo sapiens
gaaggcgacccacgagggagcag

SEQ ID NO: 10213 - RNA, 23 nt, Homo sapiens
aaggcgacccacgagggagcagg

SEQ ID NO: 10214 - RNA, 23 nt, Homo sapiens
aggcgacccacgagggagcaggg

SEQ ID NO: 10215 - RNA, 23 nt, Homo sapiens
ggcgacccacgagggagcagggu

SEQ ID NO: 10216 - RNA, 23 nt, Homo sapiens
gcgacccacgagggagcagggug

SEQ ID NO: 10217 - RNA, 23 nt, Homo sapiens
cgacccacgagggagcaggguga

SEQ ID NO: 10218 - RNA, 23 nt, Homo sapiens
gacccacgagggagcagggugac

SEQ ID NO: 10219 - RNA, 23 nt, Homo sapiens
acccacgagggagcagggugacc

SEQ ID NO: 10220 - RNA, 23 nt, Homo sapiens
cccacgagggagcagggugaccc

SEQ ID NO: 10221 - RNA, 23 nt, Homo sapiens
ccacgagggagcagggugacccc

SEQ ID NO: 10222 - RNA, 23 nt, Homo sapiens
cacgagggagcagggugaccccc

SEQ ID NO: 10223 - RNA, 23 nt, Homo sapiens
acgagggagcagggugacccccg

SEQ ID NO: 10224 - RNA, 23 nt, Homo sapiens
cgagggagcagggugacccccgc

SEQ ID NO: 10225 - RNA, 23 nt, Homo sapiens
gagggagcagggugacccccgcc

SEQ ID NO: 10226 - RNA, 23 nt, Homo sapiens
agggagcagggugacccccgccg

SEQ ID NO: 10227 - RNA, 23 nt, Homo sapiens
gggagcagggugacccccgccgg

SEQ ID NO: 10228 - RNA, 23 nt, Homo sapiens
ggagcagggugacccccgccggg

SEQ ID NO: 10229 - RNA, 23 nt, Homo sapiens
gagcagggugacccccgccgggg

SEQ ID NO: 10230 - RNA, 23 nt, Homo sapiens
agcagggugacccccgccggggg

SEQ ID NO: 10231 - RNA, 23 nt, Homo sapiens
gcagggugacccccgccgggggc

SEQ ID NO: 10232 - RNA, 23 nt, Homo sapiens
cagggugacccccgccgggggcc

SEQ ID NO: 10233 - RNA, 23 nt, Homo sapiens
agggugacccccgccgggggccg

SEQ ID NO: 10234 - RNA, 23 nt, Homo sapiens
gggugacccccgccgggggccgc

SEQ ID NO: 10235 - RNA, 23 nt, Homo sapiens
ggugacccccgccgggggccgcg

SEQ ID NO: 10236 - RNA, 23 nt, Homo sapiens
gugacccccgccgggggccgcgc

SEQ ID NO: 10237 - RNA, 23 nt, Homo sapiens
ugacccccgccgggggccgcgcu

SEQ ID NO: 10238 - RNA, 23 nt, Homo sapiens
gacccccgccgggggccgcgcug

SEQ ID NO: 10239 - RNA, 23 nt, Homo sapiens
acccccgccgggggccgcgcugc

SEQ ID NO: 10240 - RNA, 23 nt, Homo sapiens
cccccgccgggggccgcgcugca

SEQ ID NO: 10241 - RNA, 23 nt, Homo sapiens
ccccgccgggggccgcgcugcac

SEQ ID NO: 10242 - RNA, 23 nt, Homo sapiens
cccgccgggggccgcgcugcaca

SEQ ID NO: 10243 - RNA, 23 nt, Homo sapiens
ccgccgggggccgcgcugcacag

SEQ ID NO: 10244 - RNA, 23 nt, Homo sapiens
cgccgggggccgcgcugcacagg

SEQ ID NO: 10245 - RNA, 23 nt, Homo sapiens
gccgggggccgcgcugcacaggc

SEQ ID NO: 10246 - RNA, 23 nt, Homo sapiens
ccgggggccgcgcugcacaggcc

SEQ ID NO: 10247 - RNA, 23 nt, Homo sapiens
cgggggccgcgcugcacaggccg

SEQ ID NO: 10248 - RNA, 23 nt, Homo sapiens
gggggccgcgcugcacaggccgc

SEQ ID NO: 10249 - RNA, 23 nt, Homo sapiens
ggggccgcgcugcacaggccgcc

SEQ ID NO: 10250 - RNA, 23 nt, Homo sapiens
gggccgcgcugcacaggccgccu

SEQ ID NO: 10251 - RNA, 23 nt, Homo sapiens
ggccgcgcugcacaggccgccug

SEQ ID NO: 10252 - RNA, 23 nt, Homo sapiens
gccgcgcugcacaggccgccugc

SEQ ID NO: 10253 - RNA, 23 nt, Homo sapiens
ccgcgcugcacaggccgccugcc

SEQ ID NO: 10254 - RNA, 23 nt, Homo sapiens
cgcgcugcacaggccgccugccu

SEQ ID NO: 10255 - RNA, 23 nt, Homo sapiens
gcgcugcacaggccgccugccug

SEQ ID NO: 10256 - RNA, 23 nt, Homo sapiens
cgcugcacaggccgccugccugc

SEQ ID NO: 10257 - RNA, 23 nt, Homo sapiens
gcugcacaggccgccugccugcg

SEQ ID NO: 10258 - RNA, 23 nt, Homo sapiens
cugcacaggccgccugccugcgc

SEQ ID NO: 10259 - RNA, 23 nt, Homo sapiens
ugcacaggccgccugccugcgcg

SEQ ID NO: 10260 - RNA, 23 nt, Homo sapiens
gcacaggccgccugccugcgcgg

SEQ ID NO: 10261 - RNA, 23 nt, Homo sapiens
cacaggccgccugccugcgcggg

SEQ ID NO: 10262 - RNA, 23 nt, Homo sapiens
acaggccgccugccugcgcgggc

SEQ ID NO: 10263 - RNA, 23 nt, Homo sapiens
caggccgccugccugcgcgggcg

SEQ ID NO: 10264 - RNA, 23 nt, Homo sapiens
aggccgccugccugcgcgggcgc

SEQ ID NO: 10265 - RNA, 23 nt, Homo sapiens
ggccgccugccugcgcgggcgcc

SEQ ID NO: 10266 - RNA, 23 nt, Homo sapiens
gccgccugccugcgcgggcgccc

SEQ ID NO: 10267 - RNA, 23 nt, Homo sapiens
ccgccugccugcgcgggcgcccu

SEQ ID NO: 10268 - RNA, 23 nt, Homo sapiens
cgccugccugcgcgggcgcccug

SEQ ID NO: 10269 - RNA, 23 nt, Homo sapiens
gccugccugcgcgggcgcccugc

SEQ ID NO: 10270 - RNA, 23 nt, Homo sapiens
ccugccugcgcgggcgcccugcc

SEQ ID NO: 10271 - RNA, 23 nt, Homo sapiens
cugccugcgcgggcgcccugcca

SEQ ID NO: 10272 - RNA, 23 nt, Homo sapiens
ugccugcgcgggcgcccugccac

SEQ ID NO: 10273 - RNA, 23 nt, Homo sapiens
gccugcgcgggcgcccugccacc

SEQ ID NO: 10274 - RNA, 23 nt, Homo sapiens
ccugcgcgggcgcccugccaccc

SEQ ID NO: 10275 - RNA, 23 nt, Homo sapiens
cugcgcgggcgcccugccacccu

SEQ ID NO: 10276 - RNA, 23 nt, Homo sapiens
ugcgcgggcgcccugccacccug

SEQ ID NO: 10277 - RNA, 23 nt, Homo sapiens
gcgcgggcgcccugccacccugu

SEQ ID NO: 10278 - RNA, 23 nt, Homo sapiens
cgcgggcgcccugccacccuguc

SEQ ID NO: 10279 - RNA, 23 nt, Homo sapiens
gcgggcgcccugccacccugucc

SEQ ID NO: 10280 - RNA, 23 nt, Homo sapiens
cgggcgcccugccacccuguccc

SEQ ID NO: 10281 - RNA, 23 nt, Homo sapiens
gggcgcccugccacccugucccg

SEQ ID NO: 10282 - RNA, 23 nt, Homo sapiens
ggcgcccugccacccugucccgg

SEQ ID NO: 10283 - RNA, 23 nt, Homo sapiens
gcgcccugccacccugucccggg

SEQ ID NO: 10284 - RNA, 23 nt, Homo sapiens
cgcccugccacccugucccgggu

SEQ ID NO: 10285 - RNA, 23 nt, Homo sapiens
gcccugccacccugucccgggug

SEQ ID NO: 10286 - RNA, 23 nt, Homo sapiens
cccugccacccugucccgggugc

SEQ ID NO: 10287 - RNA, 23 nt, Homo sapiens
ccugccacccugucccgggugcc

SEQ ID NO: 10288 - RNA, 23 nt, Homo sapiens
cugccacccugucccgggugccu

SEQ ID NO: 10289 - RNA, 23 nt, Homo sapiens
ugccacccugucccgggugccug

SEQ ID NO: 10290 - RNA, 23 nt, Homo sapiens
gccacccugucccgggugccugg

SEQ ID NO: 10291 - RNA, 23 nt, Homo sapiens
ccacccugucccgggugccuggc

SEQ ID NO: 10292 - RNA, 23 nt, Homo sapiens
cacccugucccgggugccuggcc

SEQ ID NO: 10293 - RNA, 23 nt, Homo sapiens
acccugucccgggugccuggccc

SEQ ID NO: 10294 - RNA, 23 nt, Homo sapiens
cccugucccgggugccuggcccu

SEQ ID NO: 10295 - RNA, 23 nt, Homo sapiens
ccugucccgggugccuggcccuu

SEQ ID NO: 10296 - RNA, 23 nt, Homo sapiens
cugucccgggugccuggcccuuc

SEQ ID NO: 10297 - RNA, 23 nt, Homo sapiens
ugucccgggugccuggcccuucg

SEQ ID NO: 10298 - RNA, 23 nt, Homo sapiens
gucccgggugccuggcccuucga

SEQ ID NO: 10299 - RNA, 23 nt, Homo sapiens
ucccgggugccuggcccuucgau

SEQ ID NO: 10300 - RNA, 23 nt, Homo sapiens
cccgggugccuggcccuucgauu

SEQ ID NO: 10301 - RNA, 23 nt, Homo sapiens
ccgggugccuggcccuucgauuc

SEQ ID NO: 10302 - RNA, 23 nt, Homo sapiens
cgggugccuggcccuucgauucu

SEQ ID NO: 10303 - RNA, 23 nt, Homo sapiens
gggugccuggcccuucgauucug

SEQ ID NO: 10304 - RNA, 23 nt, Homo sapiens
ggugccuggcccuucgauucuga

SEQ ID NO: 10305 - RNA, 23 nt, Homo sapiens
gugccuggcccuucgauucugaa

SEQ ID NO: 10306 - RNA, 23 nt, Homo sapiens
ugccuggcccuucgauucugaaa

SEQ ID NO: 10307 - RNA, 23 nt, Homo sapiens
gccuggcccuucgauucugaaac

SEQ ID NO: 10308 - RNA, 23 nt, Homo sapiens
ccuggcccuucgauucugaaacc

SEQ ID NO: 10309 - RNA, 23 nt, Homo sapiens
cuggcccuucgauucugaaacca

SEQ ID NO: 10310 - RNA, 23 nt, Homo sapiens
uggcccuucgauucugaaaccag

SEQ ID NO: 10311 - RNA, 23 nt, Homo sapiens
ggcccuucgauucugaaaccaga

SEQ ID NO: 10312 - RNA, 23 nt, Homo sapiens
gcccuucgauucugaaaccagau

SEQ ID NO: 10313 - RNA, 23 nt, Homo sapiens
cccuucgauucugaaaccagauc

SEQ ID NO: 10314 - RNA, 23 nt, Homo sapiens
ccuucgauucugaaaccagaucu

SEQ ID NO: 10315 - RNA, 23 nt, Homo sapiens
cuucgauucugaaaccagaucug

SEQ ID NO: 10316 - RNA, 23 nt, Homo sapiens
uucgauucugaaaccagaucuga

SEQ ID NO: 10317 - RNA, 23 nt, Homo sapiens
ucgauucugaaaccagaucugaa

SEQ ID NO: 10318 - RNA, 23 nt, Homo sapiens
cgauucugaaaccagaucugaau

SEQ ID NO: 10319 - RNA, 23 nt, Homo sapiens
gauucugaaaccagaucugaauc

SEQ ID NO: 10320 - RNA, 23 nt, Homo sapiens
auucugaaaccagaucugaaucc

SEQ ID NO: 10321 - RNA, 23 nt, Homo sapiens
uucugaaaccagaucugaauccu

SEQ ID NO: 10322 - RNA, 23 nt, Homo sapiens
ucugaaaccagaucugaauccug

SEQ ID NO: 10323 - RNA, 23 nt, Homo sapiens
cugaaaccagaucugaauccugg

SEQ ID NO: 10324 - RNA, 23 nt, Homo sapiens
ugaaaccagaucugaauccugga

SEQ ID NO: 10325 - RNA, 23 nt, Homo sapiens
gaaaccagaucugaauccuggac

SEQ ID NO: 10326 - RNA, 23 nt, Homo sapiens
aaaccagaucugaauccuggacu

SEQ ID NO: 10327 - RNA, 23 nt, Homo sapiens
aaccagaucugaauccuggacuc

SEQ ID NO: 10328 - RNA, 23 nt, Homo sapiens
accagaucugaauccuggacucc

SEQ ID NO: 10329 - RNA, 23 nt, Homo sapiens
ccagaucugaauccuggacuccg

SEQ ID NO: 10330 - RNA, 23 nt, Homo sapiens
cagaucugaauccuggacuccgg

SEQ ID NO: 10331 - RNA, 23 nt, Homo sapiens
agaucugaauccuggacuccggg

SEQ ID NO: 10332 - RNA, 23 nt, Homo sapiens
gaucugaauccuggacuccggga

SEQ ID NO: 10333 - RNA, 23 nt, Homo sapiens
aucugaauccuggacuccgggag

SEQ ID NO: 10334 - RNA, 23 nt, Homo sapiens
ucugaauccuggacuccgggagg

SEQ ID NO: 10335 - RNA, 23 nt, Homo sapiens
cugaauccuggacuccgggaggc

SEQ ID NO: 10336 - RNA, 23 nt, Homo sapiens
ugaauccuggacuccgggaggcc

SEQ ID NO: 10337 - RNA, 23 nt, Homo sapiens
gaauccuggacuccgggaggccc

SEQ ID NO: 10338 - RNA, 23 nt, Homo sapiens
aauccuggacuccgggaggcccg

SEQ ID NO: 10339 - RNA, 23 nt, Homo sapiens
auccuggacuccgggaggcccgu

SEQ ID NO: 10340 - RNA, 23 nt, Homo sapiens
uccuggacuccgggaggcccguc

SEQ ID NO: 10341 - RNA, 23 nt, Homo sapiens
ccuggacuccgggaggcccgucu

SEQ ID NO: 10342 - RNA, 23 nt, Homo sapiens
cuggacuccgggaggcccgucuc

SEQ ID NO: 10343 - RNA, 23 nt, Homo sapiens
uggacuccgggaggcccgucucu

SEQ ID NO: 10344 - RNA, 23 nt, Homo sapiens
ggacuccgggaggcccgucucuc

SEQ ID NO: 10345 - RNA, 23 nt, Homo sapiens
gacuccgggaggcccgucucucu

SEQ ID NO: 10346 - RNA, 23 nt, Homo sapiens
acuccgggaggcccgucucucug

SEQ ID NO: 10347 - RNA, 23 nt, Homo sapiens
cuccgggaggcccgucucucugg

SEQ ID NO: 10348 - RNA, 23 nt, Homo sapiens
uccgggaggcccgucucucuggc

SEQ ID NO: 10349 - RNA, 23 nt, Homo sapiens
ccgggaggcccgucucucuggcc

SEQ ID NO: 10350 - RNA, 23 nt, Homo sapiens
cgggaggcccgucucucuggcca

SEQ ID NO: 10351 - RNA, 23 nt, Homo sapiens
gggaggcccgucucucuggccag

SEQ ID NO: 10352 - RNA, 23 nt, Homo sapiens
ggaggcccgucucucuggccagc

SEQ ID NO: 10353 - RNA, 23 nt, Homo sapiens
gaggcccgucucucuggccagcu

SEQ ID NO: 10354 - RNA, 23 nt, Homo sapiens
aggcccgucucucuggccagcuc

SEQ ID NO: 10355 - RNA, 23 nt, Homo sapiens
ggcccgucucucuggccagcucc

SEQ ID NO: 10356 - RNA, 23 nt, Homo sapiens
gcccgucucucuggccagcuccu

SEQ ID NO: 10357 - RNA, 23 nt, Homo sapiens
cccgucucucuggccagcuccuc

SEQ ID NO: 10358 - RNA, 23 nt, Homo sapiens
ccgucucucuggccagcuccucc

SEQ ID NO: 10359 - RNA, 23 nt, Homo sapiens
cgucucucuggccagcuccuccc

SEQ ID NO: 10360 - RNA, 23 nt, Homo sapiens
gucucucuggccagcuccucccg

SEQ ID NO: 10361 - RNA, 23 nt, Homo sapiens
ucucucuggccagcuccucccgg

SEQ ID NO: 10362 - RNA, 23 nt, Homo sapiens
cucucuggccagcuccucccggg

SEQ ID NO: 10363 - RNA, 23 nt, Homo sapiens
ucucuggccagcuccucccgggc

SEQ ID NO: 10364 - RNA, 23 nt, Homo sapiens
cucuggccagcuccucccgggcg

SEQ ID NO: 10365 - RNA, 23 nt, Homo sapiens
ucuggccagcuccucccgggcgg

SEQ ID NO: 10366 - RNA, 23 nt, Homo sapiens
cuggccagcuccucccgggcggc

SEQ ID NO: 10367 - RNA, 23 nt, Homo sapiens
uggccagcuccucccgggcggcg

SEQ ID NO: 10368 - RNA, 23 nt, Homo sapiens
ggccagcuccucccgggcggcga

SEQ ID NO: 10369 - RNA, 23 nt, Homo sapiens
gccagcuccucccgggcggcgau

SEQ ID NO: 10370 - RNA, 23 nt, Homo sapiens
ccagcuccucccgggcggcgaug

SEQ ID NO: 10371 - RNA, 23 nt, Homo sapiens
cagcuccucccgggcggcgaugc

SEQ ID NO: 10372 - RNA, 23 nt, Homo sapiens
agcuccucccgggcggcgaugcc

SEQ ID NO: 10373 - RNA, 23 nt, Homo sapiens
gcuccucccgggcggcgaugccu

SEQ ID NO: 10374 - RNA, 23 nt, Homo sapiens
cuccucccgggcggcgaugccug

SEQ ID NO: 10375 - RNA, 23 nt, Homo sapiens
uccucccgggcggcgaugccugg

SEQ ID NO: 10376 - RNA, 23 nt, Homo sapiens
ccucccgggcggcgaugccugga

SEQ ID NO: 10377 - RNA, 23 nt, Homo sapiens
cucccgggcggcgaugccuggaa

SEQ ID NO: 10378 - RNA, 23 nt, Homo sapiens
ucccgggcggcgaugccuggaaa

SEQ ID NO: 10379 - RNA, 23 nt, Homo sapiens
cccgggcggcgaugccuggaaag

SEQ ID NO: 10380 - RNA, 23 nt, Homo sapiens
ccgggcggcgaugccuggaaagc

SEQ ID NO: 10381 - RNA, 23 nt, Homo sapiens
cgggcggcgaugccuggaaagcg

SEQ ID NO: 10382 - RNA, 23 nt, Homo sapiens
gggcggcgaugccuggaaagcga

SEQ ID NO: 10383 - RNA, 23 nt, Homo sapiens
ggcggcgaugccuggaaagcgau

SEQ ID NO: 10384 - RNA, 23 nt, Homo sapiens
gcggcgaugccuggaaagcgauc

SEQ ID NO: 10385 - RNA, 23 nt, Homo sapiens
cggcgaugccuggaaagcgaucc

SEQ ID NO: 10386 - RNA, 23 nt, Homo sapiens
ggcgaugccuggaaagcgauccu

SEQ ID NO: 10387 - RNA, 23 nt, Homo sapiens
gcgaugccuggaaagcgauccuu

SEQ ID NO: 10388 - RNA, 23 nt, Homo sapiens
cgaugccuggaaagcgauccuuc

SEQ ID NO: 10389 - RNA, 23 nt, Homo sapiens
gaugccuggaaagcgauccuucu

SEQ ID NO: 10390 - RNA, 23 nt, Homo sapiens
augccuggaaagcgauccuucuc

SEQ ID NO: 10391 - RNA, 23 nt, Homo sapiens
ugccuggaaagcgauccuucuca

SEQ ID NO: 10392 - RNA, 23 nt, Homo sapiens
gccuggaaagcgauccuucucaa

SEQ ID NO: 10393 - RNA, 23 nt, Homo sapiens
ccuggaaagcgauccuucucaaa

SEQ ID NO: 10394 - RNA, 23 nt, Homo sapiens
cuggaaagcgauccuucucaaag

SEQ ID NO: 10395 - RNA, 23 nt, Homo sapiens
uggaaagcgauccuucucaaagg

SEQ ID NO: 10396 - RNA, 23 nt, Homo sapiens
ggaaagcgauccuucucaaaggc

SEQ ID NO: 10397 - RNA, 23 nt, Homo sapiens
gaaagcgauccuucucaaaggcu

SEQ ID NO: 10398 - RNA, 23 nt, Homo sapiens
aaagcgauccuucucaaaggcuc

SEQ ID NO: 10399 - RNA, 23 nt, Homo sapiens
aagcgauccuucucaaaggcucg

SEQ ID NO: 10400 - RNA, 23 nt, Homo sapiens
agcgauccuucucaaaggcucgg

SEQ ID NO: 10401 - RNA, 23 nt, Homo sapiens
gcgauccuucucaaaggcucgga

SEQ ID NO: 10402 - RNA, 23 nt, Homo sapiens
cgauccuucucaaaggcucggag

SEQ ID NO: 10403 - RNA, 23 nt, Homo sapiens
gauccuucucaaaggcucggagg

SEQ ID NO: 10404 - RNA, 23 nt, Homo sapiens
auccuucucaaaggcucggagga

SEQ ID NO: 10405 - RNA, 23 nt, Homo sapiens
uccuucucaaaggcucggaggag

SEQ ID NO: 10406 - RNA, 23 nt, Homo sapiens
ccuucucaaaggcucggaggagc

SEQ ID NO: 10407 - RNA, 23 nt, Homo sapiens
cuucucaaaggcucggaggagca

SEQ ID NO: 10408 - RNA, 23 nt, Homo sapiens
uucucaaaggcucggaggagcag

SEQ ID NO: 10409 - RNA, 23 nt, Homo sapiens
ucucaaaggcucggaggagcagg

SEQ ID NO: 10410 - RNA, 23 nt, Homo sapiens
cucaaaggcucggaggagcaggg

SEQ ID NO: 10411 - RNA, 23 nt, Homo sapiens
ucaaaggcucggaggagcagggc

SEQ ID NO: 10412 - RNA, 23 nt, Homo sapiens
caaaggcucggaggagcagggcg

SEQ ID NO: 10413 - RNA, 23 nt, Homo sapiens
aaaggcucggaggagcagggcgg

SEQ ID NO: 10414 - RNA, 23 nt, Homo sapiens
aaggcucggaggagcagggcggu

SEQ ID NO: 10415 - RNA, 23 nt, Homo sapiens
aggcucggaggagcagggcgguc

SEQ ID NO: 10416 - RNA, 23 nt, Homo sapiens
ggcucggaggagcagggcggucu

SEQ ID NO: 10417 - RNA, 23 nt, Homo sapiens
gcucggaggagcagggcggucug

SEQ ID NO: 10418 - RNA, 23 nt, Homo sapiens
cucggaggagcagggcggucugg

SEQ ID NO: 10419 - RNA, 23 nt, Homo sapiens
ucggaggagcagggcggucuggg

SEQ ID NO: 10420 - RNA, 23 nt, Homo sapiens
cggaggagcagggcggucuggga

SEQ ID NO: 10421 - RNA, 23 nt, Homo sapiens
ggaggagcagggcggucugggau

SEQ ID NO: 10422 - RNA, 23 nt, Homo sapiens
gaggagcagggcggucugggauc

SEQ ID NO: 10423 - RNA, 23 nt, Homo sapiens
aggagcagggcggucugggaucc

SEQ ID NO: 10424 - RNA, 23 nt, Homo sapiens
ggagcagggcggucugggauccg

SEQ ID NO: 10425 - RNA, 23 nt, Homo sapiens
gagcagggcggucugggauccgg

SEQ ID NO: 10426 - RNA, 23 nt, Homo sapiens
agcagggcggucugggauccggu

SEQ ID NO: 10427 - RNA, 23 nt, Homo sapiens
gcagggcggucugggauccggug

SEQ ID NO: 10428 - RNA, 23 nt, Homo sapiens
cagggcggucugggauccgguga

SEQ ID NO: 10429 - RNA, 23 nt, Homo sapiens
agggcggucugggauccggugac

SEQ ID NO: 10430 - RNA, 23 nt, Homo sapiens
gggcggucugggauccggugacg

SEQ ID NO: 10431 - RNA, 23 nt, Homo sapiens
ggcggucugggauccggugacgg

SEQ ID NO: 10432 - RNA, 23 nt, Homo sapiens
gcggucugggauccggugacggc

SEQ ID NO: 10433 - RNA, 23 nt, Homo sapiens
cggucugggauccggugacggcg

SEQ ID NO: 10434 - RNA, 23 nt, Homo sapiens
ggucugggauccggugacggcgg

SEQ ID NO: 10435 - RNA, 23 nt, Homo sapiens
gucugggauccggugacggcggu

SEQ ID NO: 10436 - RNA, 23 nt, Homo sapiens
ucugggauccggugacggcgguc

SEQ ID NO: 10437 - RNA, 23 nt, Homo sapiens
cugggauccggugacggcggucc

SEQ ID NO: 10438 - RNA, 23 nt, Homo sapiens
ugggauccggugacggcgguccg

SEQ ID NO: 10439 - RNA, 23 nt, Homo sapiens
gggauccggugacggcgguccgc

SEQ ID NO: 10440 - RNA, 23 nt, Homo sapiens
ggauccggugacggcgguccgcu

SEQ ID NO: 10441 - RNA, 23 nt, Homo sapiens
gauccggugacggcgguccgcuu

SEQ ID NO: 10442 - RNA, 23 nt, Homo sapiens
auccggugacggcgguccgcuuu

SEQ ID NO: 10443 - RNA, 23 nt, Homo sapiens
uccggugacggcgguccgcuuuc

SEQ ID NO: 10444 - RNA, 23 nt, Homo sapiens
ccggugacggcgguccgcuuucg

SEQ ID NO: 10445 - RNA, 23 nt, Homo sapiens
cggugacggcgguccgcuuucgc

SEQ ID NO: 10446 - RNA, 23 nt, Homo sapiens
ggugacggcgguccgcuuucgcc

SEQ ID NO: 10447 - RNA, 23 nt, Homo sapiens
gugacggcgguccgcuuucgccg

SEQ ID NO: 10448 - RNA, 23 nt, Homo sapiens
ugacggcgguccgcuuucgccgg

SEQ ID NO: 10449 - RNA, 23 nt, Homo sapiens
gacggcgguccgcuuucgccggc

SEQ ID NO: 10450 - RNA, 23 nt, Homo sapiens
acggcgguccgcuuucgccggcc

SEQ ID NO: 10451 - RNA, 23 nt, Homo sapiens
cggcgguccgcuuucgccggccu

SEQ ID NO: 10452 - RNA, 23 nt, Homo sapiens
ggcgguccgcuuucgccggccuu

SEQ ID NO: 10453 - RNA, 23 nt, Homo sapiens
gcgguccgcuuucgccggccuuc

SEQ ID NO: 10454 - RNA, 23 nt, Homo sapiens
cgguccgcuuucgccggccuucu

SEQ ID NO: 10455 - RNA, 23 nt, Homo sapiens
gguccgcuuucgccggccuucug

SEQ ID NO: 10456 - RNA, 23 nt, Homo sapiens
guccgcuuucgccggccuucugg

SEQ ID NO: 10457 - RNA, 23 nt, Homo sapiens
uccgcuuucgccggccuucuggc

SEQ ID NO: 10458 - RNA, 23 nt, Homo sapiens
ccgcuuucgccggccuucuggcg

SEQ ID NO: 10459 - RNA, 23 nt, Homo sapiens
cgcuuucgccggccuucuggcgg

SEQ ID NO: 10460 - RNA, 23 nt, Homo sapiens
gcuuucgccggccuucuggcggg

SEQ ID NO: 10461 - RNA, 23 nt, Homo sapiens
cuuucgccggccuucuggcgggc

SEQ ID NO: 10462 - RNA, 23 nt, Homo sapiens
uuucgccggccuucuggcgggcc

SEQ ID NO: 10463 - RNA, 23 nt, Homo sapiens
uucgccggccuucuggcgggccg

SEQ ID NO: 10464 - RNA, 23 nt, Homo sapiens
ucgccggccuucuggcgggccgc

SEQ ID NO: 10465 - RNA, 23 nt, Homo sapiens
cgccggccuucuggcgggccgcg

SEQ ID NO: 10466 - RNA, 23 nt, Homo sapiens
gccggccuucuggcgggccgcgu

SEQ ID NO: 10467 - RNA, 23 nt, Homo sapiens
ccggccuucuggcgggccgcguc

SEQ ID NO: 10468 - RNA, 23 nt, Homo sapiens
cggccuucuggcgggccgcgucu

SEQ ID NO: 10469 - RNA, 23 nt, Homo sapiens
ggccuucuggcgggccgcgucuc

SEQ ID NO: 10470 - RNA, 23 nt, Homo sapiens
gccuucuggcgggccgcgucucc

SEQ ID NO: 10471 - RNA, 23 nt, Homo sapiens
ccuucuggcgggccgcgucuccc

SEQ ID NO: 10472 - RNA, 23 nt, Homo sapiens
cuucuggcgggccgcgucucccg

SEQ ID NO: 10473 - RNA, 23 nt, Homo sapiens
uucuggcgggccgcgucucccgg

SEQ ID NO: 10474 - RNA, 23 nt, Homo sapiens
ucuggcgggccgcgucucccggg

SEQ ID NO: 10475 - RNA, 23 nt, Homo sapiens
cuggcgggccgcgucucccgggc

SEQ ID NO: 10476 - RNA, 23 nt, Homo sapiens
uggcgggccgcgucucccgggcc

SEQ ID NO: 10477 - RNA, 23 nt, Homo sapiens
ggcgggccgcgucucccgggcca

SEQ ID NO: 10478 - RNA, 23 nt, Homo sapiens
gcgggccgcgucucccgggccag

SEQ ID NO: 10479 - RNA, 23 nt, Homo sapiens
cgggccgcgucucccgggccagg

SEQ ID NO: 10480 - RNA, 23 nt, Homo sapiens
gggccgcgucucccgggccaggg

SEQ ID NO: 10481 - RNA, 23 nt, Homo sapiens
ggccgcgucucccgggccagggc

SEQ ID NO: 10482 - RNA, 23 nt, Homo sapiens
gccgcgucucccgggccagggcc

SEQ ID NO: 10483 - RNA, 23 nt, Homo sapiens
ccgcgucucccgggccagggccg

SEQ ID NO: 10484 - RNA, 23 nt, Homo sapiens
cgcgucucccgggccagggccga

SEQ ID NO: 10485 - RNA, 23 nt, Homo sapiens
gcgucucccgggccagggccgag

SEQ ID NO: 10486 - RNA, 23 nt, Homo sapiens
cgucucccgggccagggccgaga

SEQ ID NO: 10487 - RNA, 23 nt, Homo sapiens
gucucccgggccagggccgagau

SEQ ID NO: 10488 - RNA, 23 nt, Homo sapiens
ucucccgggccagggccgagauu

SEQ ID NO: 10489 - RNA, 23 nt, Homo sapiens
cucccgggccagggccgagauuc

SEQ ID NO: 10490 - RNA, 23 nt, Homo sapiens
ucccgggccagggccgagauucc

SEQ ID NO: 10491 - RNA, 23 nt, Homo sapiens
cccgggccagggccgagauuccc

SEQ ID NO: 10492 - RNA, 23 nt, Homo sapiens
ccgggccagggccgagauucccg

SEQ ID NO: 10493 - RNA, 23 nt, Homo sapiens
cgggccagggccgagauucccgc

SEQ ID NO: 10494 - RNA, 23 nt, Homo sapiens
gggccagggccgagauucccgcc

SEQ ID NO: 10495 - RNA, 23 nt, Homo sapiens
ggccagggccgagauucccgccg

SEQ ID NO: 10496 - RNA, 23 nt, Homo sapiens
gccagggccgagauucccgccgg

SEQ ID NO: 10497 - RNA, 23 nt, Homo sapiens
ccagggccgagauucccgccggu

SEQ ID NO: 10498 - RNA, 23 nt, Homo sapiens
cagggccgagauucccgccggug

SEQ ID NO: 10499 - RNA, 23 nt, Homo sapiens
agggccgagauucccgccggugc

SEQ ID NO: 10500 - RNA, 23 nt, Homo sapiens
gggccgagauucccgccggugcu

SEQ ID NO: 10501 - RNA, 23 nt, Homo sapiens
ggccgagauucccgccggugcug

SEQ ID NO: 10502 - RNA, 23 nt, Homo sapiens
gccgagauucccgccggugcugc

SEQ ID NO: 10503 - RNA, 23 nt, Homo sapiens
ccgagauucccgccggugcugcc

SEQ ID NO: 10504 - RNA, 23 nt, Homo sapiens
cgagauucccgccggugcugccu

SEQ ID NO: 10505 - RNA, 23 nt, Homo sapiens
gagauucccgccggugcugccuc

SEQ ID NO: 10506 - RNA, 23 nt, Homo sapiens
agauucccgccggugcugccuca

SEQ ID NO: 10507 - RNA, 23 nt, Homo sapiens
gauucccgccggugcugccucag

SEQ ID NO: 10508 - RNA, 23 nt, Homo sapiens
auucccgccggugcugccucagc

SEQ ID NO: 10509 - RNA, 23 nt, Homo sapiens
uucccgccggugcugccucagcu

SEQ ID NO: 10510 - RNA, 23 nt, Homo sapiens
ucccgccggugcugccucagcug

SEQ ID NO: 10511 - RNA, 23 nt, Homo sapiens
cccgccggugcugccucagcugg

SEQ ID NO: 10512 - RNA, 23 nt, Homo sapiens
ccgccggugcugccucagcuggc

SEQ ID NO: 10513 - RNA, 23 nt, Homo sapiens
cgccggugcugccucagcuggcg

SEQ ID NO: 10514 - RNA, 23 nt, Homo sapiens
gccggugcugccucagcuggcgu

SEQ ID NO: 10515 - RNA, 23 nt, Homo sapiens
ccggugcugccucagcuggcgug

SEQ ID NO: 10516 - RNA, 23 nt, Homo sapiens
cggugcugccucagcuggcguga

SEQ ID NO: 10517 - RNA, 23 nt, Homo sapiens
ggugcugccucagcuggcgugac

SEQ ID NO: 10518 - RNA, 23 nt, Homo sapiens
gugcugccucagcuggcgugacc

SEQ ID NO: 10519 - RNA, 23 nt, Homo sapiens
ugcugccucagcuggcgugaccu

SEQ ID NO: 10520 - RNA, 23 nt, Homo sapiens
gcugccucagcuggcgugaccuc

SEQ ID NO: 10521 - RNA, 23 nt, Homo sapiens
cugccucagcuggcgugaccucu

SEQ ID NO: 10522 - RNA, 23 nt, Homo sapiens
ugccucagcuggcgugaccucuc

SEQ ID NO: 10523 - RNA, 23 nt, Homo sapiens
gccucagcuggcgugaccucuca

SEQ ID NO: 10524 - RNA, 23 nt, Homo sapiens
ccucagcuggcgugaccucucau

SEQ ID NO: 10525 - RNA, 23 nt, Homo sapiens
cucagcuggcgugaccucucauu

SEQ ID NO: 10526 - RNA, 23 nt, Homo sapiens
ucagcuggcgugaccucucauuc

SEQ ID NO: 10527 - RNA, 23 nt, Homo sapiens
cagcuggcgugaccucucauucu

SEQ ID NO: 10528 - RNA, 23 nt, Homo sapiens
agcuggcgugaccucucauucug

SEQ ID NO: 10529 - RNA, 23 nt, Homo sapiens
gcuggcgugaccucucauucuga

SEQ ID NO: 10530 - RNA, 23 nt, Homo sapiens
cuggcgugaccucucauucugaa

SEQ ID NO: 10531 - RNA, 23 nt, Homo sapiens
uggcgugaccucucauucugaaa

SEQ ID NO: 10532 - RNA, 23 nt, Homo sapiens
ggcgugaccucucauucugaaac

SEQ ID NO: 10533 - RNA, 23 nt, Homo sapiens
gcgugaccucucauucugaaacc

SEQ ID NO: 10534 - RNA, 23 nt, Homo sapiens
cgugaccucucauucugaaacca

SEQ ID NO: 10535 - RNA, 23 nt, Homo sapiens
gugaccucucauucugaaaccaa

SEQ ID NO: 10536 - RNA, 23 nt, Homo sapiens
ugaccucucauucugaaaccaaa

SEQ ID NO: 10537 - RNA, 23 nt, Homo sapiens
gaccucucauucugaaaccaaau

SEQ ID NO: 10538 - RNA, 23 nt, Homo sapiens
accucucauucugaaaccaaauc

SEQ ID NO: 10539 - RNA, 23 nt, Homo sapiens
ccucucauucugaaaccaaaucu

SEQ ID NO: 10540 - RNA, 23 nt, Homo sapiens
cucucauucugaaaccaaaucug

SEQ ID NO: 10541 - RNA, 23 nt, Homo sapiens
ucucauucugaaaccaaaucugg

SEQ ID NO: 10542 - RNA, 23 nt, Homo sapiens
cucauucugaaaccaaaucugga

SEQ ID NO: 10543 - RNA, 23 nt, Homo sapiens
ucauucugaaaccaaaucuggac

SEQ ID NO: 10544 - RNA, 23 nt, Homo sapiens
cauucugaaaccaaaucuggacc

SEQ ID NO: 10545 - RNA, 23 nt, Homo sapiens
auucugaaaccaaaucuggaccc

SEQ ID NO: 10546 - RNA, 23 nt, Homo sapiens
uucugaaaccaaaucuggacccu

SEQ ID NO: 10547 - RNA, 23 nt, Homo sapiens
ucugaaaccaaaucuggacccug

SEQ ID NO: 10548 - RNA, 23 nt, Homo sapiens
cugaaaccaaaucuggacccugg

SEQ ID NO: 10549 - RNA, 23 nt, Homo sapiens
ugaaaccaaaucuggacccuggg

SEQ ID NO: 10550 - RNA, 23 nt, Homo sapiens
gaaaccaaaucuggacccugggc

SEQ ID NO: 10551 - RNA, 23 nt, Homo sapiens
aaaccaaaucuggacccugggcu

SEQ ID NO: 10552 - RNA, 23 nt, Homo sapiens
aaccaaaucuggacccugggcuc

SEQ ID NO: 10553 - RNA, 23 nt, Homo sapiens
accaaaucuggacccugggcucc

SEQ ID NO: 10554 - RNA, 23 nt, Homo sapiens
ccaaaucuggacccugggcuccg

SEQ ID NO: 10555 - RNA, 23 nt, Homo sapiens
caaaucuggacccugggcuccgg

SEQ ID NO: 10556 - RNA, 23 nt, Homo sapiens
aaaucuggacccugggcuccgga

SEQ ID NO: 10557 - RNA, 23 nt, Homo sapiens
aaucuggacccugggcuccggaa

SEQ ID NO: 10558 - RNA, 23 nt, Homo sapiens
aucuggacccugggcuccggaau

SEQ ID NO: 10559 - RNA, 23 nt, Homo sapiens
ucuggacccugggcuccggaaug

SEQ ID NO: 10560 - RNA, 23 nt, Homo sapiens
cuggacccugggcuccggaaugc

SEQ ID NO: 10561 - RNA, 23 nt, Homo sapiens
uggacccugggcuccggaaugcc

SEQ ID NO: 10562 - RNA, 23 nt, Homo sapiens
ggacccugggcuccggaaugccg

SEQ ID NO: 10563 - RNA, 23 nt, Homo sapiens
gacccugggcuccggaaugccga

SEQ ID NO: 10564 - RNA, 23 nt, Homo sapiens
acccugggcuccggaaugccgau

SEQ ID NO: 10565 - RNA, 23 nt, Homo sapiens
cccugggcuccggaaugccgaug

SEQ ID NO: 10566 - RNA, 23 nt, Homo sapiens
ccugggcuccggaaugccgaugg

SEQ ID NO: 10567 - RNA, 23 nt, Homo sapiens
cugggcuccggaaugccgauggc

SEQ ID NO: 10568 - RNA, 23 nt, Homo sapiens
ugggcuccggaaugccgauggcc

SEQ ID NO: 10569 - RNA, 23 nt, Homo sapiens
gggcuccggaaugccgauggccu

SEQ ID NO: 10570 - RNA, 23 nt, Homo sapiens
ggcuccggaaugccgauggccug

SEQ ID NO: 10571 - RNA, 23 nt, Homo sapiens
gcuccggaaugccgauggccugg

SEQ ID NO: 10572 - RNA, 23 nt, Homo sapiens
cuccggaaugccgauggccuggg

SEQ ID NO: 10573 - RNA, 23 nt, Homo sapiens
uccggaaugccgauggccugggc

SEQ ID NO: 10574 - RNA, 23 nt, Homo sapiens
ccggaaugccgauggccugggcc

SEQ ID NO: 10575 - RNA, 23 nt, Homo sapiens
cggaaugccgauggccugggcca

SEQ ID NO: 10576 - RNA, 23 nt, Homo sapiens
ggaaugccgauggccugggccag

SEQ ID NO: 10577 - RNA, 23 nt, Homo sapiens
gaaugccgauggccugggccagc

SEQ ID NO: 10578 - RNA, 23 nt, Homo sapiens
aaugccgauggccugggccagcc

SEQ ID NO: 10579 - RNA, 23 nt, Homo sapiens
augccgauggccugggccagccg

SEQ ID NO: 10580 - RNA, 23 nt, Homo sapiens
ugccgauggccugggccagccgu

SEQ ID NO: 10581 - RNA, 23 nt, Homo sapiens
gccgauggccugggccagccguu

SEQ ID NO: 10582 - RNA, 23 nt, Homo sapiens
ccgauggccugggccagccguuc

SEQ ID NO: 10583 - RNA, 23 nt, Homo sapiens
cgauggccugggccagccguucu

SEQ ID NO: 10584 - RNA, 23 nt, Homo sapiens
gauggccugggccagccguucuc

SEQ ID NO: 10585 - RNA, 23 nt, Homo sapiens
auggccugggccagccguucucu

SEQ ID NO: 10586 - RNA, 23 nt, Homo sapiens
uggccugggccagccguucucug

SEQ ID NO: 10587 - RNA, 23 nt, Homo sapiens
ggccugggccagccguucucugg

SEQ ID NO: 10588 - RNA, 23 nt, Homo sapiens
gccugggccagccguucucuggu

SEQ ID NO: 10589 - RNA, 23 nt, Homo sapiens
ccugggccagccguucucuggug

SEQ ID NO: 10590 - RNA, 23 nt, Homo sapiens
cugggccagccguucucuggugg

SEQ ID NO: 10591 - RNA, 23 nt, Homo sapiens
ugggccagccguucucugguggc

SEQ ID NO: 10592 - RNA, 23 nt, Homo sapiens
gggccagccguucucugguggcg

SEQ ID NO: 10593 - RNA, 23 nt, Homo sapiens
ggccagccguucucugguggcga

SEQ ID NO: 10594 - RNA, 23 nt, Homo sapiens
gccagccguucucugguggcgau

SEQ ID NO: 10595 - RNA, 23 nt, Homo sapiens
ccagccguucucugguggcgaug

SEQ ID NO: 10596 - RNA, 23 nt, Homo sapiens
cagccguucucugguggcgaugc

SEQ ID NO: 10597 - RNA, 23 nt, Homo sapiens
agccguucucugguggcgaugcc

SEQ ID NO: 10598 - RNA, 23 nt, Homo sapiens
gccguucucugguggcgaugccc

SEQ ID NO: 10599 - RNA, 23 nt, Homo sapiens
ccguucucugguggcgaugcccg

SEQ ID NO: 10600 - RNA, 23 nt, Homo sapiens
cguucucugguggcgaugcccgg

SEQ ID NO: 10601 - RNA, 23 nt, Homo sapiens
guucucugguggcgaugcccggg

SEQ ID NO: 10602 - RNA, 23 nt, Homo sapiens
uucucugguggcgaugcccgggu

SEQ ID NO: 10603 - RNA, 23 nt, Homo sapiens
ucucugguggcgaugcccgggua

SEQ ID NO: 10604 - RNA, 23 nt, Homo sapiens
cucugguggcgaugcccggguac

SEQ ID NO: 10605 - RNA, 23 nt, Homo sapiens
ucugguggcgaugcccggguacg

SEQ ID NO: 10606 - RNA, 23 nt, Homo sapiens
cugguggcgaugcccggguacgg

SEQ ID NO: 10607 - RNA, 23 nt, Homo sapiens
ugguggcgaugcccggguacggg

SEQ ID NO: 10608 - RNA, 23 nt, Homo sapiens
gguggcgaugcccggguacgggu

SEQ ID NO: 10609 - RNA, 23 nt, Homo sapiens
guggcgaugcccggguacggguu

SEQ ID NO: 10610 - RNA, 23 nt, Homo sapiens
uggcgaugcccggguacggguuc

SEQ ID NO: 10611 - RNA, 23 nt, Homo sapiens
ggcgaugcccggguacggguucc

SEQ ID NO: 10612 - RNA, 23 nt, Homo sapiens
gcgaugcccggguacggguuccg

SEQ ID NO: 10613 - RNA, 23 nt, Homo sapiens
cgaugcccggguacggguuccgc

SEQ ID NO: 10614 - RNA, 23 nt, Homo sapiens
gaugcccggguacggguuccgcu

SEQ ID NO: 10615 - RNA, 23 nt, Homo sapiens
augcccggguacggguuccgcuc

SEQ ID NO: 10616 - RNA, 23 nt, Homo sapiens
ugcccggguacggguuccgcuca

SEQ ID NO: 10617 - RNA, 23 nt, Homo sapiens
gcccggguacggguuccgcucaa

SEQ ID NO: 10618 - RNA, 23 nt, Homo sapiens
cccggguacggguuccgcucaaa

SEQ ID NO: 10619 - RNA, 23 nt, Homo sapiens
ccggguacggguuccgcucaaag

SEQ ID NO: 10620 - RNA, 23 nt, Homo sapiens
cggguacggguuccgcucaaagc

SEQ ID NO: 10621 - RNA, 23 nt, Homo sapiens
ggguacggguuccgcucaaagca

SEQ ID NO: 10622 - RNA, 23 nt, Homo sapiens
gguacggguuccgcucaaagcag

SEQ ID NO: 10623 - RNA, 23 nt, Homo sapiens
guacggguuccgcucaaagcagg

SEQ ID NO: 10624 - RNA, 23 nt, Homo sapiens
uacggguuccgcucaaagcaggc

SEQ ID NO: 10625 - RNA, 23 nt, Homo sapiens
acggguuccgcucaaagcaggcu

SEQ ID NO: 10626 - RNA, 23 nt, Homo sapiens
cggguuccgcucaaagcaggcuc

SEQ ID NO: 10627 - RNA, 23 nt, Homo sapiens
ggguuccgcucaaagcaggcucg

SEQ ID NO: 10628 - RNA, 23 nt, Homo sapiens
gguuccgcucaaagcaggcucgc

SEQ ID NO: 10629 - RNA, 23 nt, Homo sapiens
guuccgcucaaagcaggcucgca

SEQ ID NO: 10630 - RNA, 23 nt, Homo sapiens
uuccgcucaaagcaggcucgcag

SEQ ID NO: 10631 - RNA, 23 nt, Homo sapiens
uccgcucaaagcaggcucgcagg

SEQ ID NO: 10632 - RNA, 23 nt, Homo sapiens
ccgcucaaagcaggcucgcaggg

SEQ ID NO: 10633 - RNA, 23 nt, Homo sapiens
cgcucaaagcaggcucgcagggc

SEQ ID NO: 10634 - RNA, 23 nt, Homo sapiens
gcucaaagcaggcucgcagggcc

SEQ ID NO: 10635 - RNA, 23 nt, Homo sapiens
cucaaagcaggcucgcagggccu

SEQ ID NO: 10636 - RNA, 23 nt, Homo sapiens
ucaaagcaggcucgcagggccuc

SEQ ID NO: 10637 - RNA, 23 nt, Homo sapiens
caaagcaggcucgcagggccucg

SEQ ID NO: 10638 - RNA, 23 nt, Homo sapiens
aaagcaggcucgcagggccucgc

SEQ ID NO: 10639 - RNA, 23 nt, Homo sapiens
aagcaggcucgcagggccucgcu

SEQ ID NO: 10640 - RNA, 23 nt, Homo sapiens
agcaggcucgcagggccucgcuu

SEQ ID NO: 10641 - RNA, 23 nt, Homo sapiens
gcaggcucgcagggccucgcuuu

SEQ ID NO: 10642 - RNA, 23 nt, Homo sapiens
caggcucgcagggccucgcuuug

SEQ ID NO: 10643 - RNA, 23 nt, Homo sapiens
aggcucgcagggccucgcuuugg

SEQ ID NO: 10644 - RNA, 23 nt, Homo sapiens
ggcucgcagggccucgcuuuggc

SEQ ID NO: 10645 - RNA, 23 nt, Homo sapiens
gcucgcagggccucgcuuuggcu

SEQ ID NO: 10646 - RNA, 23 nt, Homo sapiens
cucgcagggccucgcuuuggcuc

SEQ ID NO: 10647 - RNA, 23 nt, Homo sapiens
ucgcagggccucgcuuuggcucg

SEQ ID NO: 10648 - RNA, 23 nt, Homo sapiens
cgcagggccucgcuuuggcucgg

SEQ ID NO: 10649 - RNA, 23 nt, Homo sapiens
gcagggccucgcuuuggcucggg

SEQ ID NO: 10650 - RNA, 23 nt, Homo sapiens
cagggccucgcuuuggcucgggg

SEQ ID NO: 10651 - RNA, 23 nt, Homo sapiens
agggccucgcuuuggcucggggu

SEQ ID NO: 10652 - RNA, 23 nt, Homo sapiens
gggccucgcuuuggcucgggguc

SEQ ID NO: 10653 - RNA, 23 nt, Homo sapiens
ggccucgcuuuggcucggggucc

SEQ ID NO: 10654 - RNA, 23 nt, Homo sapiens
gccucgcuuuggcucggggucca

SEQ ID NO: 10655 - RNA, 23 nt, Homo sapiens
ccucgcuuuggcucgggguccaa

SEQ ID NO: 10656 - RNA, 23 nt, Homo sapiens
cucgcuuuggcucgggguccaaa

SEQ ID NO: 10657 - RNA, 23 nt, Homo sapiens
ucgcuuuggcucgggguccaaac

SEQ ID NO: 10658 - RNA, 23 nt, Homo sapiens
cgcuuuggcucgggguccaaacg

SEQ ID NO: 10659 - RNA, 23 nt, Homo sapiens
gcuuuggcucgggguccaaacga

SEQ ID NO: 10660 - RNA, 23 nt, Homo sapiens
cuuuggcucgggguccaaacgag

SEQ ID NO: 10661 - RNA, 23 nt, Homo sapiens
uuuggcucgggguccaaacgagu

SEQ ID NO: 10662 - RNA, 23 nt, Homo sapiens
uuggcucgggguccaaacgaguc

SEQ ID NO: 10663 - RNA, 23 nt, Homo sapiens
uggcucgggguccaaacgagucu

SEQ ID NO: 10664 - RNA, 23 nt, Homo sapiens
ggcucgggguccaaacgagucuc

SEQ ID NO: 10665 - RNA, 23 nt, Homo sapiens
gcucgggguccaaacgagucucc

SEQ ID NO: 10666 - RNA, 23 nt, Homo sapiens
cucgggguccaaacgagucuccg

SEQ ID NO: 10667 - RNA, 23 nt, Homo sapiens
ucgggguccaaacgagucuccgu

SEQ ID NO: 10668 - RNA, 23 nt, Homo sapiens
cgggguccaaacgagucuccguc

SEQ ID NO: 10669 - RNA, 23 nt, Homo sapiens
gggguccaaacgagucuccgucg

SEQ ID NO: 10670 - RNA, 23 nt, Homo sapiens
ggguccaaacgagucuccgucgc

SEQ ID NO: 10671 - RNA, 23 nt, Homo sapiens
gguccaaacgagucuccgucgcc

SEQ ID NO: 10672 - RNA, 23 nt, Homo sapiens
guccaaacgagucuccgucgccg

SEQ ID NO: 10673 - RNA, 23 nt, Homo sapiens
uccaaacgagucuccgucgccgu

SEQ ID NO: 10674 - RNA, 23 nt, Homo sapiens
ccaaacgagucuccgucgccguc

SEQ ID NO: 10675 - RNA, 23 nt, Homo sapiens
caaacgagucuccgucgccgucc

SEQ ID NO: 10676 - RNA, 23 nt, Homo sapiens
aaacgagucuccgucgccguccu

SEQ ID NO: 10677 - RNA, 23 nt, Homo sapiens
aacgagucuccgucgccguccuc

SEQ ID NO: 10678 - RNA, 23 nt, Homo sapiens
acgagucuccgucgccguccucg

SEQ ID NO: 10679 - RNA, 23 nt, Homo sapiens
cgagucuccgucgccguccucgu

SEQ ID NO: 10680 - RNA, 23 nt, Homo sapiens
gagucuccgucgccguccucguc

SEQ ID NO: 10681 - RNA, 23 nt, Homo sapiens
agucuccgucgccguccucgucc

SEQ ID NO: 10682 - RNA, 23 nt, Homo sapiens
gucuccgucgccguccucguccc

SEQ ID NO: 10683 - RNA, 23 nt, Homo sapiens
ucuccgucgccguccucgucccc

SEQ ID NO: 10684 - RNA, 23 nt, Homo sapiens
cuccgucgccguccucguccccg

SEQ ID NO: 10685 - RNA, 23 nt, Homo sapiens
uccgucgccguccucguccccgg

SEQ ID NO: 10686 - RNA, 23 nt, Homo sapiens
ccgucgccguccucguccccggg

SEQ ID NO: 10687 - RNA, 23 nt, Homo sapiens
cgucgccguccucguccccgggc

SEQ ID NO: 10688 - RNA, 23 nt, Homo sapiens
gucgccguccucguccccgggcu

SEQ ID NO: 10689 - RNA, 23 nt, Homo sapiens
ucgccguccucguccccgggcuu

SEQ ID NO: 10690 - RNA, 23 nt, Homo sapiens
cgccguccucguccccgggcuuc

SEQ ID NO: 10691 - RNA, 23 nt, Homo sapiens
gccguccucguccccgggcuucc

SEQ ID NO: 10692 - RNA, 23 nt, Homo sapiens
ccguccucguccccgggcuuccg

SEQ ID NO: 10693 - RNA, 23 nt, Homo sapiens
cguccucguccccgggcuuccgc

SEQ ID NO: 10694 - RNA, 23 nt, Homo sapiens
guccucguccccgggcuuccgcg

SEQ ID NO: 10695 - RNA, 23 nt, Homo sapiens
uccucguccccgggcuuccgcgg

SEQ ID NO: 10696 - RNA, 23 nt, Homo sapiens
ccucguccccgggcuuccgcggg

SEQ ID NO: 10697 - RNA, 23 nt, Homo sapiens
cucguccccgggcuuccgcgggg

SEQ ID NO: 10698 - RNA, 23 nt, Homo sapiens
ucguccccgggcuuccgcgggga

SEQ ID NO: 10699 - RNA, 23 nt, Homo sapiens
cguccccgggcuuccgcggggag

SEQ ID NO: 10700 - RNA, 23 nt, Homo sapiens
guccccgggcuuccgcggggagg

SEQ ID NO: 10701 - RNA, 23 nt, Homo sapiens
uccccgggcuuccgcggggaggg

SEQ ID NO: 10702 - RNA, 23 nt, Homo sapiens
ccccgggcuuccgcggggagggu

SEQ ID NO: 10703 - RNA, 23 nt, Homo sapiens
cccgggcuuccgcggggagggug

SEQ ID NO: 10704 - RNA, 23 nt, Homo sapiens
ccgggcuuccgcggggagggugc

SEQ ID NO: 10705 - RNA, 23 nt, Homo sapiens
cgggcuuccgcggggagggugcu

SEQ ID NO: 10706 - RNA, 23 nt, Homo sapiens
gggcuuccgcggggagggugcug

SEQ ID NO: 10707 - RNA, 23 nt, Homo sapiens
ggcuuccgcggggagggugcugu

SEQ ID NO: 10708 - RNA, 23 nt, Homo sapiens
gcuuccgcggggagggugcuguc

SEQ ID NO: 10709 - RNA, 23 nt, Homo sapiens
cuuccgcggggagggugcugucc

SEQ ID NO: 10710 - RNA, 23 nt, Homo sapiens
uuccgcggggagggugcuguccg

SEQ ID NO: 10711 - RNA, 23 nt, Homo sapiens
uccgcggggagggugcuguccga

SEQ ID NO: 10712 - RNA, 23 nt, Homo sapiens
ccgcggggagggugcuguccgag

SEQ ID NO: 10713 - RNA, 23 nt, Homo sapiens
cgcggggagggugcuguccgagg

SEQ ID NO: 10714 - RNA, 23 nt, Homo sapiens
gcggggagggugcuguccgaggg

SEQ ID NO: 10715 - RNA, 23 nt, Homo sapiens
cggggagggugcuguccgagggu

SEQ ID NO: 10716 - RNA, 23 nt, Homo sapiens
ggggagggugcuguccgagggug

SEQ ID NO: 10717 - RNA, 23 nt, Homo sapiens
gggagggugcuguccgagggugu

SEQ ID NO: 10718 - RNA, 23 nt, Homo sapiens
ggagggugcuguccgaggguguc

SEQ ID NO: 10719 - RNA, 23 nt, Homo sapiens
gagggugcuguccgagggugucg

SEQ ID NO: 10720 - RNA, 23 nt, Homo sapiens
agggugcuguccgagggugucgg

SEQ ID NO: 10721 - RNA, 23 nt, Homo sapiens
gggugcuguccgagggugucggg

SEQ ID NO: 10722 - RNA, 23 nt, Homo sapiens
ggugcuguccgagggugucggga

SEQ ID NO: 10723 - RNA, 23 nt, Homo sapiens
gugcuguccgagggugucgggag

SEQ ID NO: 10724 - RNA, 23 nt, Homo sapiens
ugcuguccgagggugucgggagg

SEQ ID NO: 10725 - RNA, 23 nt, Homo sapiens
gcuguccgagggugucgggaggg

SEQ ID NO: 10726 - RNA, 23 nt, Homo sapiens
cuguccgagggugucgggagggc

SEQ ID NO: 10727 - RNA, 23 nt, Homo sapiens
uguccgagggugucgggagggcc

SEQ ID NO: 10728 - RNA, 23 nt, Homo sapiens
guccgagggugucgggagggcca

SEQ ID NO: 10729 - RNA, 23 nt, Homo sapiens
uccgagggugucgggagggccau

SEQ ID NO: 10730 - RNA, 23 nt, Homo sapiens
ccgagggugucgggagggccauc

SEQ ID NO: 10731 - RNA, 23 nt, Homo sapiens
cgagggugucgggagggccaucg

SEQ ID NO: 10732 - RNA, 23 nt, Homo sapiens
gagggugucgggagggccaucgc

SEQ ID NO: 10733 - RNA, 23 nt, Homo sapiens
agggugucgggagggccaucgcg

SEQ ID NO: 10734 - RNA, 23 nt, Homo sapiens
gggugucgggagggccaucgcgg

SEQ ID NO: 10735 - RNA, 23 nt, Homo sapiens
ggugucgggagggccaucgcggu

SEQ ID NO: 10736 - RNA, 23 nt, Homo sapiens
gugucgggagggccaucgcggug

SEQ ID NO: 10737 - RNA, 23 nt, Homo sapiens
ugucgggagggccaucgcgguga

SEQ ID NO: 10738 - RNA, 23 nt, Homo sapiens
gucgggagggccaucgcggugag

SEQ ID NO: 10739 - RNA, 23 nt, Homo sapiens
ucgggagggccaucgcggugagc

SEQ ID NO: 10740 - RNA, 23 nt, Homo sapiens
cgggagggccaucgcggugagcc

SEQ ID NO: 10741 - RNA, 23 nt, Homo sapiens
gggagggccaucgcggugagccc

SEQ ID NO: 10742 - RNA, 23 nt, Homo sapiens
ggagggccaucgcggugagcccc

SEQ ID NO: 10743 - RNA, 23 nt, Homo sapiens
gagggccaucgcggugagccccg

SEQ ID NO: 10744 - RNA, 23 nt, Homo sapiens
agggccaucgcggugagccccgg

SEQ ID NO: 10745 - RNA, 23 nt, Homo sapiens
gggccaucgcggugagccccggc

SEQ ID NO: 10746 - RNA, 23 nt, Homo sapiens
ggccaucgcggugagccccggcc

SEQ ID NO: 10747 - RNA, 23 nt, Homo sapiens
gccaucgcggugagccccggccg

SEQ ID NO: 10748 - RNA, 23 nt, Homo sapiens
ccaucgcggugagccccggccgg

SEQ ID NO: 10749 - RNA, 23 nt, Homo sapiens
caucgcggugagccccggccgga

SEQ ID NO: 10750 - RNA, 23 nt, Homo sapiens
aucgcggugagccccggccggaa

SEQ ID NO: 10751 - RNA, 23 nt, Homo sapiens
ucgcggugagccccggccggaau

SEQ ID NO: 10752 - RNA, 23 nt, Homo sapiens
cgcggugagccccggccggaauu

SEQ ID NO: 10753 - RNA, 23 nt, Homo sapiens
gcggugagccccggccggaauuu

SEQ ID NO: 10754 - RNA, 23 nt, Homo sapiens
cggugagccccggccggaauuuc

SEQ ID NO: 10755 - RNA, 23 nt, Homo sapiens
ggugagccccggccggaauuuca

SEQ ID NO: 10756 - RNA, 23 nt, Homo sapiens
gugagccccggccggaauuucac

SEQ ID NO: 10757 - RNA, 23 nt, Homo sapiens
ugagccccggccggaauuucacg

SEQ ID NO: 10758 - RNA, 23 nt, Homo sapiens
gagccccggccggaauuucacgg

SEQ ID NO: 10759 - RNA, 23 nt, Homo sapiens
agccccggccggaauuucacgga

SEQ ID NO: 10760 - RNA, 23 nt, Homo sapiens
gccccggccggaauuucacggac

SEQ ID NO: 10761 - RNA, 23 nt, Homo sapiens
ccccggccggaauuucacggacg

SEQ ID NO: 10762 - RNA, 23 nt, Homo sapiens
cccggccggaauuucacggacgg

SEQ ID NO: 10763 - RNA, 23 nt, Homo sapiens
ccggccggaauuucacggacgga

SEQ ID NO: 10764 - RNA, 23 nt, Homo sapiens
cggccggaauuucacggacggac

SEQ ID NO: 10765 - RNA, 23 nt, Homo sapiens
ggccggaauuucacggacggacg

SEQ ID NO: 10766 - RNA, 23 nt, Homo sapiens
gccggaauuucacggacggacgc

SEQ ID NO: 10767 - RNA, 23 nt, Homo sapiens
ccggaauuucacggacggacgcg

SEQ ID NO: 10768 - RNA, 23 nt, Homo sapiens
cggaauuucacggacggacgcgg

SEQ ID NO: 10769 - RNA, 23 nt, Homo sapiens
ggaauuucacggacggacgcggg

SEQ ID NO: 10770 - RNA, 23 nt, Homo sapiens
gaauuucacggacggacgcgggc

SEQ ID NO: 10771 - RNA, 23 nt, Homo sapiens
aauuucacggacggacgcgggca

SEQ ID NO: 10772 - RNA, 23 nt, Homo sapiens
auuucacggacggacgcgggcag

SEQ ID NO: 10773 - RNA, 23 nt, Homo sapiens
uuucacggacggacgcgggcaga

SEQ ID NO: 10774 - RNA, 23 nt, Homo sapiens
uucacggacggacgcgggcagag

SEQ ID NO: 10775 - RNA, 23 nt, Homo sapiens
ucacggacggacgcgggcagaga

SEQ ID NO: 10776 - RNA, 23 nt, Homo sapiens
cacggacggacgcgggcagagag

SEQ ID NO: 10777 - RNA, 23 nt, Homo sapiens
acggacggacgcgggcagagaga

SEQ ID NO: 10778 - RNA, 23 nt, Homo sapiens
cggacggacgcgggcagagagag

SEQ ID NO: 10779 - RNA, 23 nt, Homo sapiens
ggacggacgcgggcagagagagg

SEQ ID NO: 10780 - RNA, 23 nt, Homo sapiens
gacggacgcgggcagagagaggc

SEQ ID NO: 10781 - RNA, 23 nt, Homo sapiens
acggacgcgggcagagagaggcc

SEQ ID NO: 10782 - RNA, 23 nt, Homo sapiens
cggacgcgggcagagagaggccg

SEQ ID NO: 10783 - RNA, 23 nt, Homo sapiens
ggacgcgggcagagagaggccgg

SEQ ID NO: 10784 - RNA, 23 nt, Homo sapiens
gacgcgggcagagagaggccggc

SEQ ID NO: 10785 - RNA, 23 nt, Homo sapiens
acgcgggcagagagaggccggcg

SEQ ID NO: 10786 - RNA, 23 nt, Homo sapiens
cgcgggcagagagaggccggcgg

SEQ ID NO: 10787 - RNA, 23 nt, Homo sapiens
gcgggcagagagaggccggcggg

SEQ ID NO: 10788 - RNA, 23 nt, Homo sapiens
cgggcagagagaggccggcgggc

SEQ ID NO: 10789 - RNA, 23 nt, Homo sapiens
gggcagagagaggccggcgggcu

SEQ ID NO: 10790 - RNA, 23 nt, Homo sapiens
ggcagagagaggccggcgggcuc

SEQ ID NO: 10791 - RNA, 23 nt, Homo sapiens
gcagagagaggccggcgggcucc

SEQ ID NO: 10792 - RNA, 23 nt, Homo sapiens
cagagagaggccggcgggcuccc

SEQ ID NO: 10793 - RNA, 23 nt, Homo sapiens
agagagaggccggcgggcucccg

SEQ ID NO: 10794 - RNA, 23 nt, Homo sapiens
gagagaggccggcgggcucccgu

SEQ ID NO: 10795 - RNA, 23 nt, Homo sapiens
agagaggccggcgggcucccgug

SEQ ID NO: 10796 - RNA, 23 nt, Homo sapiens
gagaggccggcgggcucccgugc

SEQ ID NO: 10797 - RNA, 23 nt, Homo sapiens
agaggccggcgggcucccgugca

SEQ ID NO: 10798 - RNA, 23 nt, Homo sapiens
gaggccggcgggcucccgugcac

SEQ ID NO: 10799 - RNA, 23 nt, Homo sapiens
aggccggcgggcucccgugcacc

SEQ ID NO: 10800 - RNA, 23 nt, Homo sapiens
ggccggcgggcucccgugcaccu

SEQ ID NO: 10801 - RNA, 23 nt, Homo sapiens
gccggcgggcucccgugcaccuc

SEQ ID NO: 10802 - RNA, 23 nt, Homo sapiens
ccggcgggcucccgugcaccuca

SEQ ID NO: 10803 - RNA, 23 nt, Homo sapiens
cggcgggcucccgugcaccucag

SEQ ID NO: 10804 - RNA, 23 nt, Homo sapiens
ggcgggcucccgugcaccucagc

SEQ ID NO: 10805 - RNA, 23 nt, Homo sapiens
gcgggcucccgugcaccucagcc

SEQ ID NO: 10806 - RNA, 23 nt, Homo sapiens
cgggcucccgugcaccucagccg

SEQ ID NO: 10807 - RNA, 23 nt, Homo sapiens
gggcucccgugcaccucagccgg

SEQ ID NO: 10808 - RNA, 23 nt, Homo sapiens
ggcucccgugcaccucagccgga

SEQ ID NO: 10809 - RNA, 23 nt, Homo sapiens
gcucccgugcaccucagccggac

SEQ ID NO: 10810 - RNA, 23 nt, Homo sapiens
cucccgugcaccucagccggacu

SEQ ID NO: 10811 - RNA, 23 nt, Homo sapiens
ucccgugcaccucagccggacug

SEQ ID NO: 10812 - RNA, 23 nt, Homo sapiens
cccgugcaccucagccggacugu

SEQ ID NO: 10813 - RNA, 23 nt, Homo sapiens
ccgugcaccucagccggacugug

SEQ ID NO: 10814 - RNA, 23 nt, Homo sapiens
cgugcaccucagccggacugugc

SEQ ID NO: 10815 - RNA, 23 nt, Homo sapiens
gugcaccucagccggacugugca

SEQ ID NO: 10816 - RNA, 23 nt, Homo sapiens
ugcaccucagccggacugugcac

SEQ ID NO: 10817 - RNA, 23 nt, Homo sapiens
gcaccucagccggacugugcacu

SEQ ID NO: 10818 - RNA, 23 nt, Homo sapiens
caccucagccggacugugcacug

SEQ ID NO: 10819 - RNA, 23 nt, Homo sapiens
accucagccggacugugcacugc

SEQ ID NO: 10820 - RNA, 23 nt, Homo sapiens
ccucagccggacugugcacugcg

SEQ ID NO: 10821 - RNA, 23 nt, Homo sapiens
cucagccggacugugcacugcgg

SEQ ID NO: 10822 - RNA, 23 nt, Homo sapiens
ucagccggacugugcacugcggc

SEQ ID NO: 10823 - RNA, 23 nt, Homo sapiens
cagccggacugugcacugcggca

SEQ ID NO: 10824 - RNA, 23 nt, Homo sapiens
agccggacugugcacugcggcag

SEQ ID NO: 10825 - RNA, 23 nt, Homo sapiens
gccggacugugcacugcggcagg

SEQ ID NO: 10826 - RNA, 23 nt, Homo sapiens
ccggacugugcacugcggcaggu

SEQ ID NO: 10827 - RNA, 23 nt, Homo sapiens
cggacugugcacugcggcaggug

SEQ ID NO: 10828 - RNA, 23 nt, Homo sapiens
ggacugugcacugcggcaggugc

SEQ ID NO: 10829 - RNA, 23 nt, Homo sapiens
gacugugcacugcggcaggugca

SEQ ID NO: 10830 - RNA, 23 nt, Homo sapiens
acugugcacugcggcaggugcag

SEQ ID NO: 10831 - RNA, 23 nt, Homo sapiens
cugugcacugcggcaggugcagc

SEQ ID NO: 10832 - RNA, 23 nt, Homo sapiens
ugugcacugcggcaggugcagcc

SEQ ID NO: 10833 - RNA, 23 nt, Homo sapiens
gugcacugcggcaggugcagcca

SEQ ID NO: 10834 - RNA, 23 nt, Homo sapiens
ugcacugcggcaggugcagccag

SEQ ID NO: 10835 - RNA, 23 nt, Homo sapiens
gcacugcggcaggugcagccagg

SEQ ID NO: 10836 - RNA, 23 nt, Homo sapiens
cacugcggcaggugcagccagga

SEQ ID NO: 10837 - RNA, 23 nt, Homo sapiens
acugcggcaggugcagccaggag

SEQ ID NO: 10838 - RNA, 23 nt, Homo sapiens
cugcggcaggugcagccaggagg

SEQ ID NO: 10839 - RNA, 23 nt, Homo sapiens
ugcggcaggugcagccaggaggc

SEQ ID NO: 10840 - RNA, 23 nt, Homo sapiens
gcggcaggugcagccaggaggcc

SEQ ID NO: 10841 - RNA, 23 nt, Homo sapiens
cggcaggugcagccaggaggccu

SEQ ID NO: 10842 - RNA, 23 nt, Homo sapiens
ggcaggugcagccaggaggccug

SEQ ID NO: 10843 - RNA, 23 nt, Homo sapiens
gcaggugcagccaggaggccugc

SEQ ID NO: 10844 - RNA, 23 nt, Homo sapiens
caggugcagccaggaggccugcc

SEQ ID NO: 10845 - RNA, 23 nt, Homo sapiens
aggugcagccaggaggccugccc

SEQ ID NO: 10846 - RNA, 23 nt, Homo sapiens
ggugcagccaggaggccugcccg

SEQ ID NO: 10847 - RNA, 23 nt, Homo sapiens
gugcagccaggaggccugcccgg

SEQ ID NO: 10848 - RNA, 23 nt, Homo sapiens
ugcagccaggaggccugcccgga

SEQ ID NO: 10849 - RNA, 23 nt, Homo sapiens
gcagccaggaggccugcccggac

SEQ ID NO: 10850 - RNA, 23 nt, Homo sapiens
cagccaggaggccugcccggaca

SEQ ID NO: 10851 - RNA, 23 nt, Homo sapiens
agccaggaggccugcccggacag

SEQ ID NO: 10852 - RNA, 23 nt, Homo sapiens
gccaggaggccugcccggacagc

SEQ ID NO: 10853 - RNA, 23 nt, Homo sapiens
ccaggaggccugcccggacagcc

SEQ ID NO: 10854 - RNA, 23 nt, Homo sapiens
caggaggccugcccggacagcca

SEQ ID NO: 10855 - RNA, 23 nt, Homo sapiens
aggaggccugcccggacagccag

SEQ ID NO: 10856 - RNA, 23 nt, Homo sapiens
ggaggccugcccggacagccagc

SEQ ID NO: 10857 - RNA, 23 nt, Homo sapiens
gaggccugcccggacagccagcc

SEQ ID NO: 10858 - RNA, 23 nt, Homo sapiens
aggccugcccggacagccagcca

SEQ ID NO: 10859 - RNA, 23 nt, Homo sapiens
ggccugcccggacagccagccag

SEQ ID NO: 10860 - RNA, 23 nt, Homo sapiens
gccugcccggacagccagccagc

SEQ ID NO: 10861 - RNA, 23 nt, Homo sapiens
ccugcccggacagccagccagcc

SEQ ID NO: 10862 - RNA, 23 nt, Homo sapiens
cugcccggacagccagccagcca

SEQ ID NO: 10863 - RNA, 23 nt, Homo sapiens
ugcccggacagccagccagccag

SEQ ID NO: 10864 - RNA, 23 nt, Homo sapiens
gcccggacagccagccagccagc

SEQ ID NO: 10865 - RNA, 23 nt, Homo sapiens
cccggacagccagccagccagcc

SEQ ID NO: 10866 - RNA, 23 nt, Homo sapiens
ccggacagccagccagccagcca

SEQ ID NO: 10867 - RNA, 23 nt, Homo sapiens
cggacagccagccagccagccag

SEQ ID NO: 10868 - RNA, 23 nt, Homo sapiens
ggacagccagccagccagccagc

SEQ ID NO: 10869 - RNA, 23 nt, Homo sapiens
gacagccagccagccagccagcc

SEQ ID NO: 10870 - RNA, 23 nt, Homo sapiens
acagccagccagccagccagccg

SEQ ID NO: 10871 - RNA, 23 nt, Homo sapiens
cagccagccagccagccagccgc

SEQ ID NO: 10872 - RNA, 23 nt, Homo sapiens
agccagccagccagccagccgcc

SEQ ID NO: 10873 - RNA, 23 nt, Homo sapiens
gccagccagccagccagccgccc

SEQ ID NO: 10874 - RNA, 23 nt, Homo sapiens
ccagccagccagccagccgcccu

SEQ ID NO: 10875 - RNA, 23 nt, Homo sapiens
cagccagccagccagccgcccuu

SEQ ID NO: 10876 - RNA, 23 nt, Homo sapiens
agccagccagccagccgcccuug

SEQ ID NO: 10877 - RNA, 23 nt, Homo sapiens
gccagccagccagccgcccuugu

SEQ ID NO: 10878 - RNA, 23 nt, Homo sapiens
ccagccagccagccgcccuugua

SEQ ID NO: 10879 - RNA, 23 nt, Homo sapiens
cagccagccagccgcccuuguaa

SEQ ID NO: 10880 - RNA, 23 nt, Homo sapiens
agccagccagccgcccuuguaaa

SEQ ID NO: 10881 - RNA, 23 nt, Homo sapiens
gccagccagccgcccuuguaaag

SEQ ID NO: 10882 - RNA, 23 nt, Homo sapiens
ccagccagccgcccuuguaaagg

SEQ ID NO: 10883 - RNA, 23 nt, Homo sapiens
cagccagccgcccuuguaaaggc

SEQ ID NO: 10884 - RNA, 23 nt, Homo sapiens
agccagccgcccuuguaaaggcc

SEQ ID NO: 10885 - RNA, 23 nt, Homo sapiens
gccagccgcccuuguaaaggccc

SEQ ID NO: 10886 - RNA, 23 nt, Homo sapiens
ccagccgcccuuguaaaggccca

SEQ ID NO: 10887 - RNA, 23 nt, Homo sapiens
cagccgcccuuguaaaggcccac

SEQ ID NO: 10888 - RNA, 23 nt, Homo sapiens
agccgcccuuguaaaggcccaca

SEQ ID NO: 10889 - RNA, 23 nt, Homo sapiens
gccgcccuuguaaaggcccacag

SEQ ID NO: 10890 - RNA, 23 nt, Homo sapiens
ccgcccuuguaaaggcccacagg

SEQ ID NO: 10891 - RNA, 23 nt, Homo sapiens
cgcccuuguaaaggcccacaggc

SEQ ID NO: 10892 - RNA, 23 nt, Homo sapiens
gcccuuguaaaggcccacaggca

SEQ ID NO: 10893 - RNA, 23 nt, Homo sapiens
cccuuguaaaggcccacaggcag

SEQ ID NO: 10894 - RNA, 23 nt, Homo sapiens
ccuuguaaaggcccacaggcagg

SEQ ID NO: 10895 - RNA, 23 nt, Homo sapiens
cuuguaaaggcccacaggcaggc

SEQ ID NO: 10896 - RNA, 23 nt, Homo sapiens
uuguaaaggcccacaggcaggca

SEQ ID NO: 10897 - RNA, 23 nt, Homo sapiens
uguaaaggcccacaggcaggcag

SEQ ID NO: 10898 - RNA, 23 nt, Homo sapiens
guaaaggcccacaggcaggcagg

SEQ ID NO: 10899 - RNA, 23 nt, Homo sapiens
uaaaggcccacaggcaggcaggc

SEQ ID NO: 10900 - RNA, 23 nt, Homo sapiens
aaaggcccacaggcaggcaggcu

SEQ ID NO: 10901 - RNA, 23 nt, Homo sapiens
aaggcccacaggcaggcaggcuc

SEQ ID NO: 10902 - RNA, 23 nt, Homo sapiens
aggcccacaggcaggcaggcucc

SEQ ID NO: 10903 - RNA, 23 nt, Homo sapiens
ggcccacaggcaggcaggcucca

SEQ ID NO: 10904 - RNA, 23 nt, Homo sapiens
gcccacaggcaggcaggcuccac

SEQ ID NO: 10905 - RNA, 23 nt, Homo sapiens
cccacaggcaggcaggcuccacc

SEQ ID NO: 10906 - RNA, 23 nt, Homo sapiens
ccacaggcaggcaggcuccaccc

SEQ ID NO: 10907 - RNA, 23 nt, Homo sapiens
cacaggcaggcaggcuccacccc

SEQ ID NO: 10908 - RNA, 23 nt, Homo sapiens
acaggcaggcaggcuccaccccu

SEQ ID NO: 10909 - RNA, 23 nt, Homo sapiens
caggcaggcaggcuccaccccuu

SEQ ID NO: 10910 - RNA, 23 nt, Homo sapiens
aggcaggcaggcuccaccccuuc

SEQ ID NO: 10911 - RNA, 23 nt, Homo sapiens
ggcaggcaggcuccaccccuuca

SEQ ID NO: 10912 - RNA, 23 nt, Homo sapiens
gcaggcaggcuccaccccuucau

SEQ ID NO: 10913 - DNA, 91 bp, Artificial Sequence
  Synthetic Polynucleotide
  misc_feature: mi405
ctcgagtgagcgatccaggattcagatctggtttctatttagtgtgataatggtgtttaaaccagatctgaatcctggactgcctactagt

SEQ ID NO: 10914 - DNA, 88 bp, Artificial Sequence
  Synthetic Polynucleotide
  misc_feature: mi1155
ctcgagtgagcgacaggcgcaacctctcctagaatatttagtgtgataatggtgtttctaggagaggttgcgcctgctgcctactagt

SEQ ID NO: 10915 - DNA, 114 bp, Artificial Sequence
  Synthetic Polynucleotide
  misc_feature: mi405
ctcgagtatttagtgtgataatggtgtttctcgggtgagcgatccaggattcagatctggtttctgaaagccacagatgggaaaccagatctgaatcctggactgcctactagt

SEQ ID NO: 10916 - DNA, 115 bp, Artificial Sequence
  Synthetic Polynucleotide
  misc_feature: mi1155
ctcgagtatttagtgtgataatggtgtttctcgggtgagcgacaggcgcaacctctcctagaactgtaaagccacagatgggttctaggagaggttgcgcctgctgcctactagt

SEQ ID NO: 10917 - DNA, 114 bp, Artificial Sequence
  Synthetic Polynucleotide
  misc_feature: mi405
ctcgagtgagcgatccaggattcagatctggtttctgaaagccacagatgggaaaccagatctgaatcctggactgcctactagatatttagtgtgataatggtgtttactagt

SEQ ID NO: 10918 - DNA, 115 bp, Artificial Sequence
  Synthetic Polynucleotide
  misc_feature: mi1155
ctcgagtgagcgacaggcgcaacctctcctagaactgtaaagccacagatgggttctaggagaggttgcgcctgctgcctactagatatttagtgtgataatggtgtttactagt

SEQ ID NO: 10919 - DNA, 93 bp, Artificial Sequence
  Synthetic Polynucleotide
  misc_feature: mi405
ctcgagtgagcgatccaggattcagatctggtttctacgagccttttgctcgtcttatggaaaccagatctgaatcctggactgcctactagt

SEQ ID NO: 10920 - DNA, 93 bp, Artificial Sequence
  Synthetic Polynucleotide
  misc_feature: mi1155
ctcgagtgagcgacaggcgcaacctctcctagaactacgagccttttgctcgtcttatggttctaggagaggttgcgcctgctgcctactagt

SEQ ID NO: 10921 - DNA, 114 bp, Artificial Sequence
  Synthetic Polynucleotide
  misc_feature: mi405
ctcgagacgagccttttgctcgtcttatctcgggtgagcgatccaggattcagatctggtttctgtaaagccacagatgggaaaccagatctgaatcctggactgcctactagt

SEQ ID NO: 10922 - DNA, 114 bp, Artificial Sequence
  Synthetic Polynucleotide
  misc_feature: mi1155
ctcgagacgagctttttgctcgtcttatctcgggtgagcgacaggcgcaacctctcctagaactgtaaagccacagatgggttctaggagaggttgcgcctgctgcctactagt

SEQ ID NO: 10923 - DNA, 114 bp, Artificial Sequence
  Synthetic Polynucleotide
  misc_feature: mi405
ctcgagtgagcgatccaggattcagatctggtttctgtaaagccacagatgggaaaccagatctgaatcctggactgcctactagaacgagccttttgctcgtcttatactagt

SEQ ID NO: 10924 - DNA, 114 bp, Artificial Sequence
  Synthetic Polynucleotide
  misc_feature: mi1155
ctcgagtgagcgacaggcgcaacctctcctagaactgtaaagccacagatgggttctaggagaggttgcgcctgctgcctactagaacgagccttttgctcgtcttatactagt

SEQ ID NO: 10925 - DNA, 143 bp, Artificial Sequence
  Synthetic Polynucleotide
  misc_feature: mi405
ctcgagtatttagtgtgataatggtgtttctcgggtgagcgatccaggattcagatctggtttctgtaaagccacagatgggaaaccagatctgaatcctggactgcctactagaacgagccttttgctcgtcttatactagt

SEQ ID NO: 10926 - DNA, 143 bp, Artificial Sequence
  Synthetic Polynucleotide
  misc_feature: mi1155
ctcgagtatttagtgtgataatggtgtttctcgggtgagcgacaggcgcaacctctcctagaactgtaaagccacagatgggttctaggagaggttgcgcctgctgcctactagaacgagccttttgctcgtcttatactagt

SEQ ID NO: 10927 - DNA, 137 bp, Artificial Sequence
  Synthetic Polynucleotide
  misc_feature: mi405
ctcgagtatttagtgtgataatggtgtttacgagccttttgctcgtcttatctcgggtgagcgatccaggattcagatctggtttctgtaaagccacagatgggaaaccagatctgaatcctggactgcctactagt

SEQ ID NO: 10928 - DNA, 137 bp, Artificial Sequence
  Synthetic Polynucleotide
  misc_feature: mi1155
ctcgagtatttagtgtgataatggtgtttacgagccttttgctcgtcttatctcgggtgagcgacaggcgcaacctctcctagaactgtaaagccacagatgggttctaggagaggttgcgcctgctgcctactagt

SEQ ID NO: 10929 - DNA, 137 bp, Artificial Sequence
  Synthetic Polynucleotide
  misc_feature: mi405
ctcgagtgagcgatccaggattcagatctggtttctgtaaagccacagatgggaaaccagatctgaatcctggactgcctactagatatttagtgtgataatggtgtttacgagccttttgctcgtcttatactagt

SEQ ID NO: 10930 - DNA, 137 bp, Artificial Sequence
  Synthetic Polynucleotide
  misc_feature: mi1155
ctcgagtgagcgacaggcgcaacctctcctagaactgtaaagccacagatgggttctaggagaggttgcgcctgctgcctactagatatttagtgtgataatggtgtttacgagccttttgctcgtcttatactagt

SEQ ID NO: 10931 - DNA, 122 bp, Artificial Sequence
  Synthetic Polynucleotide
  misc_feature: mi405
ctcgagacgagccttttgctcgtcttatctcgggtgagcgatccaggattcagatctggtttcttatttagtgtgataatggtgtttggaaaccagatctgaatcctggactgcctactagt

SEQ ID NO: 10932 - DNA, 122 bp, Artificial Sequence
  Synthetic Polynucleotide
  misc_feature: mi1155
ctcgagacgagccttttgctcgtcttatctcgggtgagcgacaggcgcaacctctcctagaacttatttagtgtgataatggtgtttggttctaggagaggttgcgcctgctgcctactagt

SEQ ID NO: 10933 - DNA, 122 bp, Artificial Sequence
  Synthetic Polynucleotide
  misc_feature: mi405
ctcgagtgagcgatccaggattcagatctggtttcttatttagtgtgataatggtgtttggaaaccagatctgaatcctggactgcctactagaacgagccttttgctcgtcttatactagt

SEQ ID NO: 10934 - DNA, 122 bp, Artificial Sequence
  Synthetic Polynucleotide
  misc_feature: mi1155
ctcgagtgagcgacaggcgcaacctctcctagaacttatttagtgtgataatggtgtttggttctaggagaggttgcgcctgctgcctactagaacgagccttttgctcgtcttatactagt

SEQ ID NO: 10935 - DNA, 122 bp, Artificial Sequence
  Synthetic Polynucleotide
  misc_feature: mi405
ctcgagtatttagtgtgataatggtgtttctcgggtgagcgatccaggattcagatctggtttctacgagccttttgctcgtcttatggaaaccagatctgaatcctggactgcctactagt

SEQ ID NO: 10936 - DNA, 122 bp, Artificial Sequence
  Synthetic Polynucleotide
  misc_feature: mi1155
ctcgagtatttagtgtgataatggtgtttctcgggtgagcgacaggcgcaacctctcctagaactacgagccttttgctcgtcttatggttctaggagaggttgcgcctgctgcctactagt

SEQ ID NO: 10937 - DNA, 122 bp, Artificial Sequence
  Synthetic Polynucleotide
  misc_feature: mi405
ctcgagtgagcgatccaggattcagatctggtttctacgagccttttgctcgtcttatggaaaccagatctgaatcctggactgcctactagatatttagtgtgataatggtgtttactagt

SEQ ID NO: 10938 - DNA, 122 bp, Artificial Sequence
  Synthetic Polynucleotide
  misc_feature: mi1155
ctcgagtgagcgacaggcgcaacctctcctagaactacgagccttttgctcgtcttatggttctaggagaggttgcgcctgctgcctactagatatttagtgtgataatggtgtttactagt

SEQ ID NO: 10939 - DNA, 115 bp, Artificial Sequence
  Synthetic Polynucleotide
  misc_feature: mi405
ctcgagtgagcgatccaggattcagatctggtttcttttagtgtgataatggtgtttgacgagctttttgctcgtcttatggaaaccagatctgaatcctggactgcctactagt

SEQ ID NO: 10940 - DNA, 115 bp, Artificial Sequence
  Synthetic Polynucleotide
  misc_feature: mi1155
ctcgagtgagcgacaggcgcaacctctcctagaacttttagtgtgataatggtgtttgacgagctttttgctcgtcttatggttctaggagaggttgcgcctgctgcctactagt

SEQ ID NO: 10941 - RNA, 91 nt, Artificial Sequence
  Synthetic Polynucleotide
  misc_feature: mi405
cucgagugagcgauccaggauucagaucugguuucuauuuagugugauaaugguguuuaaaccagaucugaauccuggacugccuacuagu

SEQ ID NO: 10942 - RNA, 88 nt, Artificial Sequence
  Synthetic Polynucleotide
  misc_feature: mi1155
cucgagugagcgacaggcgcaaccucuccuagaauauuuagugugauaaugguguuucuaggagagguugcgccugcugccuacuagu

SEQ ID NO: 10943 - RNA, 114 nt, Artificial Sequence
  Synthetic Polynucleotide
  misc_feature: mi405
cucgaguauuuagugugauaaugguguuucucgggugagcgauccaggauucagaucugguuucugaaagccacagaugggaaaccagaucugaauccuggacugccuacuagu

SEQ ID NO: 10944 - RNA, 115 nt, Artificial Sequence
  Synthetic Polynucleotide
  misc_feature: mi1155
cucgaguauuuagugugauaaugguguuucucgggugagcgacaggcgcaaccucuccuagaacuguaaagccacagauggguucuaggagagguugcgccugcugccuacuagu

SEQ ID NO: 10945 - RNA, 114 nt, Artificial Sequence
  Synthetic Polynucleotide
  misc_feature: mi405
cucgagugagcgauccaggauucagaucugguuucugaaagccacagaugggaaaccagaucugaauccuggacugccuacuagauauuuagugugauaaugguguuuacuagu

SEQ ID NO: 10946 - RNA, 115 nt, Artificial Sequence
  Synthetic Polynucleotide
  misc_feature: mi1155
cucgagugagcgacaggcgcaaccucuccuagaacuguaaagccacagauggguucuaggagagguugcgccugcugccuacuagauauuuagugugauaaugguguuuacuagu

SEQ ID NO: 10947 - RNA, 93 nt, Artificial Sequence
  Synthetic Polynucleotide
  misc_feature: mi405
cucgagugagcgauccaggauucagaucugguuucuacgagccuuuugcucgucuuauggaaaccagaucugaauccuggacugccuacuagu

SEQ ID NO: 10948 - RNA, 93 nt, Artificial Sequence
  Synthetic Polynucleotide
  misc_feature: mi1155
cucgagugagcgacaggcgcaaccucuccuagaacuacgagccuuuugcucgucuuaugguucuaggagagguugcgccugcugccuacuagu

SEQ ID NO: 10949 - RNA, 114 nt, Artificial Sequence
  Synthetic Polynucleotide
  misc_feature: mi405
cucgagacgagccuuuugcucgucuuaucucgggugagcgauccaggauucagaucugguuucuguaaagccacagaugggaaaccagaucugaauccuggacugccuacuagu

SEQ ID NO: 10950 - RNA, 114 nt, Artificial Sequence
  Synthetic Polynucleotide
  misc_feature: mi1155
cucgagacgagcuuuuugcucgucuuaucucgggugagcgacaggcgcaaccucuccuagaacuguaaagccacagauggguucuaggagagguugcgccugcugccuacuagu

SEQ ID NO: 10951 - RNA, 114 nt, Artificial Sequence
  Synthetic Polynucleotide
  misc_feature: mi405
cucgagugagcgauccaggauucagaucugguuucuguaaagccacagaugggaaaccagaucugaauccuggacugccuacuagaacgagccuuuugcucgucuuauacuagu

SEQ ID NO: 10952 - RNA, 114 nt, Artificial Sequence
  Synthetic Polynucleotide
  misc_feature: mi1155
cucgagugagcgacaggcgcaaccucuccuagaacuguaaagccacagauggguucuaggagagguugcgccugcugccuacuagaacgagccuuuugcucgucuuauacuagu

SEQ ID NO: 10953 - RNA, 143 nt, Artificial Sequence
  Synthetic Polynucleotide
  misc_feature: mi405
cucgaguauuuagugugauaaugguguuucucgggugagcgauccaggauucagaucugguuucuguaaagccacagaugggaaaccagaucugaauccuggacugccuacuagaacgagccuuuugcucgucuuauacuagu

SEQ ID NO: 10954 - RNA, 143 nt, Artificial Sequence
  Synthetic Polynucleotide
  misc_feature: mi1155
cucgaguauuuagugugauaaugguguuucucgggugagcgacaggcgcaaccucuccuagaacuguaaagccacagauggguucuaggagagguugcgccugcugccuacuagaacgagccuuuugcucgucuuauacuagu

SEQ ID NO: 10955 - RNA, 137 nt, Artificial Sequence
  Synthetic Polynucleotide
  misc_feature: mi405
cucgaguauuuagugugauaaugguguuuacgagccuuuugcucgucuuaucucgggugagcgauccaggauucagaucugguuucuguaaagccacagaugggaaaccagaucugaauccuggacugccuacuagu

SEQ ID NO: 10956 - RNA, 137 nt, Artificial Sequence
  Synthetic Polynucleotide
  misc_feature: mi1155
cucgaguauuuagugugauaaugguguuuacgagccuuuugcucgucuuaucucgggugagcgacaggcgcaaccucuccuagaacuguaaagccacagauggguucuaggagagguugcgccugcugccuacuagu

SEQ ID NO: 10957 - RNA, 137 nt, Artificial Sequence
  Synthetic Polynucleotide
  misc_feature: mi405
cucgagugagcgauccaggauucagaucugguuucuguaaagccacagaugggaaaccagaucugaauccuggacugccuacuagauauuuagugugauaaugguguuuacgagccuuuugcucgucuuauacuagu

SEQ ID NO: 10958 - RNA, 137 nt, Artificial Sequence
  Synthetic Polynucleotide
  misc_feature: mi1155
cucgagugagcgacaggcgcaaccucuccuagaacuguaaagccacagauggguucuaggagagguugcgccugcugccuacuagauauuuagugugauaaugguguuuacgagccuuuugcucgucuuauacuagu

SEQ ID NO: 10959 - RNA, 122 nt, Artificial Sequence
  Synthetic Polynucleotide
  misc_feature: mi405
cucgagacgagccuuuugcucgucuuaucucgggugagcgauccaggauucagaucugguuucuuauuuagugugauaaugguguuuggaaaccagaucugaauccuggacugccuacuagu

SEQ ID NO: 10960 - RNA, 122 nt, Artificial Sequence
  Synthetic Polynucleotide
  misc_feature: mi1155
cucgagacgagccuuuugcucgucuuaucucgggugagcgacaggcgcaaccucuccuagaacuuauuuagugugauaaugguguuugguucuaggagagguugcgccugcugccuacuagu

SEQ ID NO: 10961 - RNA, 122 nt, Artificial Sequence
  Synthetic Polynucleotide
  misc_feature: mi405
cucgagugagcgauccaggauucagaucugguuucuuauuuagugugauaaugguguuuggaaaccagaucugaauccuggacugccuacuagaacgagccuuuugcucgucuuauacuagu

SEQ ID NO: 10962 - RNA, 122 nt, Artificial Sequence
  Synthetic Polynucleotide
  misc_feature: mi1155
cucgagugagcgacaggcgcaaccucuccuagaacuuauuuagugugauaaugguguuugguucuaggagagguugcgccugcugccuacuagaacgagccuuuugcucgucuuauacuagu

SEQ ID NO: 10963 - RNA, 122 nt, Artificial Sequence
  Synthetic Polynucleotide
  misc_feature: mi405
cucgaguauuuagugugauaaugguguuucucgggugagcgauccaggauucagaucugguuucuacgagccuuuugcucgucuuauggaaaccagaucugaauccuggacugccuacuagu

SEQ ID NO: 10964 - RNA, 122 nt, Artificial Sequence
  Synthetic Polynucleotide
  misc_feature: mi1155
cucgaguauuuagugugauaaugguguuucucgggugagcgacaggcgcaaccucuccuagaacuacgagccuuuugcucgucuuaugguucuaggagagguugcgccugcugccuacuagu

SEQ ID NO: 10965 - RNA, 122 nt, Artificial Sequence
  Synthetic Polynucleotide
  misc_feature: mi405
cucgagugagcgauccaggauucagaucugguuucuacgagccuuuugcucgucuuauggaaaccagaucugaauccuggacugccuacuagauauuuagugugauaaugguguuuacuagu

SEQ ID NO: 10966 - RNA, 122 nt, Artificial Sequence
  Synthetic Polynucleotide
  misc_feature: mi1155
cucgagugagcgacaggcgcaaccucuccuagaacuacgagccuuuugcucgucuuaugguucuaggagagguugcgccugcugccuacuagauauuuagugugauaaugguguuuacuagu

SEQ ID NO: 10967 - RNA, 115 nt, Artificial Sequence
  Synthetic Polynucleotide
  misc_feature: mi405
cucgagugagcgauccaggauucagaucugguuucuuuuagugugauaaugguguuugacgagcuuuuugcucgucuuauggaaaccagaucugaauccuggacugccuacuagu

SEQ ID NO: 10968 - RNA, 115 nt, Artificial Sequence
  Synthetic Polynucleotide
  misc_feature: mi1155
cucgagugagcgacaggcgcaaccucuccuagaacuuuuagugugauaaugguguuugacgagcuuuuugcucgucuuaugguucuaggagagguugcgccugcugccuacuagu

SEQ ID NO: 10969 - RNA, 23 nt, Artificial Sequence
  Synthetic Polynucleotide
  misc_feature: Binding site for miR-122
uauuuagugugauaaugguguuu

SEQ ID NO: 10970 - RNA, 22 nt, Artificial Sequence
  Synthetic Polynucleotide
  misc_feature: Binding site for miR-208
acgagccuuuugcucgucuuau

SEQ ID NO: 10971 - RNA, 22 nt, Artificial Sequence
  Synthetic Polynucleotide
  misc_feature: Mi1519
aucucugaacuaaucauccagg

SEQ ID NO: 10972 - RNA, 22 nt, Artificial Sequence
  Synthetic Polynucleotide
  misc_feature: Mi1520
uaucucugaacuaaucauccag

SEQ ID NO: 10973 - RNA, 22 nt, Artificial Sequence
  Synthetic Polynucleotide
ccaggauucagaucugguuucu

SEQ ID NO: 10974 - RNA, 22 nt, Artificial Sequence
  Synthetic Polynucleotide
aggcgcaaccucuccuagaacu

I claim:

1. A method of inhibiting expression of the double homeo-box 4 (DUX4) gene in a cell comprising contacting the cell with a recombinant adeno-associated virus comprising a nucleic acid comprising (a) a nucleotide sequence encoding a U6 promoter;

(b) a nucleotide sequence encoding a mature guide strand of a miRNA targeting DUX4 mRNA, wherein the mature guide strand of the miRNA comprises the nucleotide sequence of SEQ ID NO: 7397 or 8147;

(c) a nucleotide sequence comprising at least one copy of a detargeting sequence comprising the mir-122 binding site having the nucleotide sequence of SEQ ID NO: 5 or 66, and/or at least one copy of a detargeting sequence comprising the miR-208 binding site having the nucleotide sequence of SEQ ID NO: 6 or 67; and (d) 5-6 thymidines at the 5' end.

2. A method of delivering double homeobox 4 (DUX4) miRNA-encoding DNA to the skeletal muscle of an animal in need thereof, comprising contacting the skeletal muscle with a recombinant adeno-associated virus comprising a nucleic acid comprising (a) a nucleotide sequence encoding a U6 promoter;

(b) a nucleotide sequence encoding a mature guide strand of a miRNA targeting DUX4 mRNA, wherein the mature guide strand of the miRNA comprises the nucleotide sequence of SEQ ID NO: 7397 or 8147;

(c) a nucleotide sequence comprising at least one copy of a detargeting sequence comprising the mir-122 binding site having the nucleotide sequence of SEQ ID NO: 5 or 66, and/or at least one copy of a detargeting sequence comprising the miR-208 binding site having the nucleotide sequence of SEQ ID NO: 6 or 67; and (d) 5-6 thymidines at the 5' end.

3. A method of treating facioscapulohumeral muscular dystrophy in a subject comprising administering to the subject an effective amount of a recombinant adeno-associated virus comprising (a) a nucleotide sequence encoding a U6 promoter;

(b) a nucleotide sequence encoding a mature guide strand of a miRNA targeting DUX4 mRNA, wherein the mature guide strand of the miRNA comprises the nucleotide sequence of SEQ ID NO: 7397 or 8147;

(c) a nucleotide sequence comprising at least one copy of a detargeting sequence comprising the mir-122 binding site having the nucleotide sequence of SEQ ID NO: 5 or 66, and/or at least one copy of a detargeting sequence comprising the miR-208 binding site having the nucleotide sequence of SEQ ID NO: 6 or 67; and (d) 5-6 thymidines at the 5' end.

4. The method of claim 2, wherein the recombinant adeno-associated virus is administered by intramuscular injection, transdermal transport, injection into the blood stream or injection into the liver.

5. The method of claim 3, wherein the recombinant adeno- associated virus is administered by intramuscular injection, transdermal transport, injection into the blood stream or injection into the liver.

6. The method of claim 1, wherein the U6 promoter comprises the nucleotide sequence of SEQ ID NO: 3.

7. The method of claim 1, wherein the nucleic acid comprises the polynucleotide sequence of any one of SEQ ID NOS: 1, 2, and 10913-10968.

8. The method of claim 1, wherein the adeno-associated virus (AAV) is AAV1, AAV2, AAV3, AAV4, AAV5, AAV6, AAV7, AAV8, AAV9, AAV10, AAV11, AAV12, AAV13, AAV rh.74 or AAV-B1.

9. The method of claim 1, wherein the adeno-associated virus (AAV) is AAV6, AAV rh.74 or AAV-B1.

10. The method of claim 2, wherein the U6 promoter comprises the nucleotide sequence of SEQ ID NO: 3.

11. The method of claim 2, wherein the nucleic acid comprises the polynucleotide sequence of any one of SEQ ID NOS: 1, 2, and 10913-10968.

12. The method of claim 2, wherein the adeno-associated virus (AAV) is AAV1, AAV2, AAV3, AAV4, AAV5, AAV6, AAV7, AAV8, AAV9, AAV10, AAV11, AAV12, AAV13, AAV rh.74 or AAV-B1.

13. The method of claim 2, wherein the adeno-associated virus (AAV) is AAV6, AAV rh.74 or AAV-B1.

14. The method of claim 3, wherein the U6 promoter comprises the nucleotide sequence of SEQ ID NO: 3.

15. The method of claim 3, wherein the nucleic acid comprises the polynucleotide sequence of any one of SEQ ID NOS: 1, 2, and 10913-10968.

16. The method of claim 3, wherein the adeno-associated virus (AAV) is AAV1, AAV2, AAV3, AAV4, AAV5, AAV6, AAV7, AAV8, AAV9, AAV10, AAV11, AAV12, AAV13, AAV rh.74 or AAV-B1.

17. The method of claim 3, wherein the adeno-associated virus (AAV) is AAV6, AAV rh.74 or AAV-B1.

18. The method of claim 1, wherein the U6 promoter comprises the nucleotide sequence of SEQ ID NO: 4.

19. The method of claim 2, wherein the U6 promoter comprises the nucleotide sequence of SEQ ID NO: 4.

20. The method of claim 3, wherein the U6 promoter comprises the nucleotide sequence of SEQ ID NO: 4.

* * * * *